US012753406B2

(12) United States Patent
Zhang et al.

(10) Patent No.: US 12,753,406 B2
(45) Date of Patent: Oct. 6, 2026

(54) CAS12B ENZYMES AND SYSTEMS

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); Jonathan Strecker, Cambridge, MA (US); Ian Slaymaker, Cambridge, MA (US); Sara Jones, Cambridge, MA (US)

(73) Assignees: The Broad Institute, Inc., Cambridge, MA (US); Massachusetts Institute of Technology, Cambridge, MA (US)

( * ) Notice: Subject to any disclaimer, the term of this patent is extended or adjusted under 35 U.S.C. 154(b) by 990 days.

(21) Appl. No.: 17/265,910

(22) PCT Filed: Aug. 7, 2019

(86) PCT No.: PCT/US2019/045582
§ 371 (c)(1),
(2) Date: Feb. 4, 2021

(87) PCT Pub. No.: WO2020/033601
PCT Pub. Date: Feb. 13, 2020

(65) Prior Publication Data
US 2021/0163944 A1 Jun. 3, 2021

Related U.S. Application Data

(60) Provisional application No. 62/831,028, filed on Apr. 8, 2019, provisional application No. 62/794,929, filed on Jan. 21, 2019, provisional application No. 62/751,196, filed on Oct. 26, 2018, provisional application No. 62/744,080, filed on Oct. 10, 2018, provisional application No. 62/715,640, filed on Aug. 7, 2018.

(51) Int. Cl.
*C07K 14/32* (2006.01)
*C12N 9/22* (2006.01)
*C12N 15/113* (2010.01)

(52) U.S. Cl.
CPC ............ *C12N 15/113* (2013.01); *C07K 14/32* (2013.01); *C12N 9/22* (2013.01); *C12N 2310/3519* (2013.01); *C12Y 301/00* (2013.01); *C12Y 304/22* (2013.01)

(58) Field of Classification Search
CPC .............................. C12N 9/22; C12N 2310/20
See application file for complete search history.

(56) References Cited

U.S. PATENT DOCUMENTS

| | | | | |
|---|---|---|---|---|
| 5,580,859 | A | 12/1996 | Felgner et al. | |
| 5,589,466 | A | 12/1996 | Felgner et al. | |
| 5,593,972 | A | 1/1997 | Weiner et al. | |
| 8,697,359 | B1 | 4/2014 | Zhang | |
| 8,709,843 | B2 | 4/2014 | Shakuda | |
| 8,771,945 | B1 | 7/2014 | Zhang | |
| 8,795,965 | B2 | 8/2014 | Zhang | |
| 8,865,406 | B2 | 10/2014 | Zhang et al. | |
| 8,871,445 | B2 | 10/2014 | Cong et al. | |
| 8,889,356 | B2 | 11/2014 | Zhang | |
| 8,889,418 | B2 | 11/2014 | Zhang et al. | |
| 8,895,308 | B1 | 11/2014 | Zhang et al. | |
| 8,906,616 | B2 | 12/2014 | Zhang et al. | |
| 8,932,814 | B2 | 1/2015 | Cong et al. | |
| 8,945,839 | B2 | 2/2015 | Zhang | |
| 8,993,233 | B2 | 3/2015 | Zhang et al. | |
| 8,999,641 | B2 | 4/2015 | Zhang et al. | |
| 9,790,490 | B2 | 10/2017 | Zhang et al. | |
| 11,180,751 | B2 * | 11/2021 | Koonin | C12N 9/22 |
| 11,384,344 | B2 * | 7/2022 | Zhang | C12N 15/70 |
| 11,453,907 | B2 * | 9/2022 | Zhang | B01L 7/52 |
| 11,633,732 | B2 * | 4/2023 | Zhang | C12Q 1/6816 435/5 |
| 11,639,523 | B2 * | 5/2023 | Zhang | C12Q 1/701 435/211 |
| 11,773,432 | B2 * | 10/2023 | Zhang | C12Q 1/6832 435/5 |
| 11,898,142 | B2 * | 2/2024 | Zhang | G01N 33/5308 |
| 2014/0170753 | A1 | 6/2014 | Zhang | |

(Continued)

FOREIGN PATENT DOCUMENTS

| | | | |
|---|---|---|---|
| CN | 109837328 | A | 6/2019 |
| EP | 2 771 468 | B1 | 2/2015 |
| EP | 2 784 162 | B1 | 4/2015 |
| EP | 2 764 103 | B1 | 8/2015 |
| EP | 3 009 511 | B1 | 5/2017 |
| WO | 2014/018423 | A2 | 1/2014 |
| WO | 2014/093595 | A1 | 6/2014 |
| WO | 2014/093622 | A2 | 6/2014 |

(Continued)

OTHER PUBLICATIONS

Chen et al., Nov. 29, 2017, "CRISPR-Cas12a target binding unleashes single-stranded DNase activity" bioRxiv, doi: 10.1101/226993 (Year: 2017).*

(Continued)

*Primary Examiner* — Soren Harward
*Assistant Examiner* — Jenna L Persons
(74) *Attorney, Agent, or Firm* — F. Brent Nix, Esq.; Johnson, Marcou, Isaacs & Nix, LLC; Drew P. Harding

(57) ABSTRACT

Described herein are systems, methods, and compositions for targeting nucleic acids. In certain example embodiments, non-naturally occurring or engineered RNA-targeting systems contain an RNA-targeting Cas12b effector protein and at least one targeting nucleic acid component like a guide RNA or crRNA.

26 Claims, 146 Drawing Sheets

Specification includes a Sequence Listing.

(56) References Cited

U.S. PATENT DOCUMENTS

| | | | | |
|---|---|---|---|---|
| 2014/0179006 | A1 | 6/2014 | Zhang | |
| 2014/0179770 | A1 | 6/2014 | Zhang et al. | |
| 2014/0186843 | A1 | 7/2014 | Zhang et al. | |
| 2014/0186919 | A1 | 7/2014 | Zhang et al. | |
| 2014/0186958 | A1 | 7/2014 | Zhang et al. | |
| 2014/0189896 | A1 | 7/2014 | Zhang et al. | |
| 2014/0227787 | A1 | 8/2014 | Zhang | |
| 2014/0234972 | A1 | 8/2014 | Zhang | |
| 2014/0242664 | A1 | 8/2014 | Zhang et al. | |
| 2014/0242699 | A1 | 8/2014 | Zhang | |
| 2014/0242700 | A1 | 8/2014 | Zhang et al. | |
| 2014/0248702 | A1 | 9/2014 | Zhang et al. | |
| 2014/0256046 | A1 | 9/2014 | Zhang et al. | |
| 2014/0273231 | A1 | 9/2014 | Zhang et al. | |
| 2014/0273232 | A1 | 9/2014 | Zhang et al. | |
| 2014/0273234 | A1 | 9/2014 | Zhang et al. | |
| 2014/0287938 | A1 | 9/2014 | Zhang et al. | |
| 2014/0310830 | A1 | 10/2014 | Zhang et al. | |
| 2015/0184139 | A1 | 7/2015 | Zhang et al. | |
| 2017/0321198 | A1* | 11/2017 | Severinov | C12N 15/85 |
| 2018/0073012 | A1* | 3/2018 | Liu | C12N 15/1024 |
| 2020/0392473 | A1* | 12/2020 | Zhang | C12N 15/8203 |
| 2021/0071163 | A1* | 3/2021 | Zhang | C12N 9/78 |
| 2023/0193242 | A1* | 6/2023 | Zhang | C12N 9/22 435/455 |

FOREIGN PATENT DOCUMENTS

| | | | | |
|---|---|---|---|---|
| WO | 2014/093635 | A1 | 6/2014 | |
| WO | 2014/093655 | A2 | 6/2014 | |
| WO | 2014/093661 | A2 | 6/2014 | |
| WO | 2014/093694 | A1 | 6/2014 | |
| WO | 2014/093701 | A1 | 6/2014 | |
| WO | 2014/093709 | A1 | 6/2014 | |
| WO | 2014/093712 | A1 | 6/2014 | |
| WO | 2014/093718 | A1 | 6/2014 | |
| WO | 2014/204723 | A1 | 12/2014 | |
| WO | 2014/204724 | A1 | 12/2014 | |
| WO | 2014/204725 | A1 | 12/2014 | |
| WO | 2014/204726 | A1 | 12/2014 | |
| WO | 2014/204727 | A1 | 12/2014 | |
| WO | 2014/204728 | A1 | 12/2014 | |
| WO | 2014/204729 | A1 | 12/2014 | |
| WO | 2015/089351 | A1 | 6/2015 | |
| WO | 2015/089354 | A1 | 6/2015 | |
| WO | 2015/089364 | A1 | 6/2015 | |
| WO | 2015/089419 | A2 | 6/2015 | |
| WO | 2015/089427 | A1 | 6/2015 | |
| WO | 2015/089462 | A1 | 6/2015 | |
| WO | 2015/089465 | A1 | 6/2015 | |
| WO | 2015/089473 | A1 | 6/2015 | |
| WO | 2015/089486 | A2 | 6/2015 | |
| WO | 2015/105928 | A1 | 7/2015 | |
| WO | 2016/028682 | A1 | 2/2016 | |
| WO | 2016/049163 | A2 | 3/2016 | |
| WO | 2016/049258 | A2 | 3/2016 | |
| WO | 2016/205749 | A1 | 12/2016 | |
| WO | WO-2016205764 | A9 * | 4/2017 | C12N 15/102 |
| WO | WO-2018107129 | A1 * | 6/2018 | B01L 3/5023 |
| WO | WO-2018161032 | A1 * | 9/2018 | A61P 21/00 |
| WO | 2019/126774 | A1 | 6/2019 | |
| WO | 2019127087 | A1 | 7/2019 | |
| WO | 2020/033601 | A1 | 2/2020 | |

OTHER PUBLICATIONS

Nguyen et al., 2022, "A thermostable Cas12b from Brevibacillus leverages one-pot discrimination of SARS-COV-2 variants of concern" eBioMedicine, 77, 103926, p. 1-12 (Year: 2022).*

Strecker et al., 2019,"Engineering of CRISPR-Cas12b for human genome editing" Nature Communications, 10:212, p. 1-8 (Year: 2019).*

Skaldin et al., 2018, "Secreted Bacterial Adenosine Deaminase Is an Evolutionary Precursor of Adenosine Deaminase Growth Factor", Mol. Biol. Evol., 35(12), p. 2851-2861 (Year: 2018).*

The Broad Institute, Inc., Notice of Rejection for Japanese Patent Application No. 2021-506471, mailed Jul. 4, 2023, 8 pages.

The Broad Institute, Inc., Notice of Rejection for Canadian Patent Application No. 3,106,035, mailed Aug. 31, 2023, 5 pages.

The Broad Institute, Inc., Notification of the First Office Action for Chinese Patent Application No. 2019800633255, mailed Aug. 11, 2023, 17 pages.

The Broad Institute, Inc., Patent Search for Chinese Patent Application No. 2019800633255, mailed Aug. 11, 2023, 6 pages.

Database Genbank, "type V CRISPR-associated protein Cas12b [Caldibacillus hisashii]", NCBI Reference Sequence: WP_095142515.1, Sep. 23, 2019, 1 page.

Database Genbank, "type V CRISPR-associated protein Cas12b [*Bacillus* sp. V3-13]", NCBI Reference Sequence: WP_101661451.1, Sep. 23, 2019, 1 page.

"International Preliminary Report on Patentability issued in International Application No. PCT/US2019/045582", mailed on Feb. 18, 2021, 14 pages.

"International Search Report and Written Opinion issued in International Application No. PCT/US2019/045582", mailed on Jan. 15, 2020, 24 pages.

"Invitation to pay Additional Fees issues in International Application No. PCTUS2019045582", mailed on Nov. 14, 2019, 16 pages.

Abudayyeh, et al., "C2C2 is a Single-Component Programmable RNA-Guided RNA-Targeting CRISPR Effector", Science, vol. 353, No. 6299, Aug. 5, 2016, 23 pages.

Basha, et al., "Influence of Cationic Lipid Composition on Gene Silencing Properties of Lipid Nanoparticle Formulations of siRNA in Antigen-Presenting Cells", Molecular Therapy, vol. 19, No. 12, Dec. 2011, 2186-2200.

Chan, et al., "Efficient Mutagenesis of the Rhodopsin Gene in Rod Photoreceptor Neurons in Mice", Nucleic Acids Research, vol. 39, No. 14, Apr. 7, 2011, 5955-5966.

Cong, et al., "Multiplex Genome Engineering Using CRISPR/Cas Systems", Science, vol. 339, No. 6121, Feb. 15, 2013, 819-823.

Cox, et al., "RNA Editing with CRISPR-Cas13", Science, vol. 358, No. 6366, Nov. 24, 2017, 1019-1027.

Database Genbank, "Type v CRISPR-Associated Protein Cas12b [Alicyclobacillus Kakegawensis]", NCBI Reference Sequence: WP_067936067.1, Sep. 23, 2019, 1 page.

East-Seletsky, et al., "Two Distinct RNase Activities of CRISPR-C2c2 Enable Guide-RNA Processing and RNA Detection", Nature, vol. 538, No. 7624, Oct. 13, 2016, 17 pages.

Gao, et al., "Engineered Cpf1 Enzymes with Altered PAM Specificities", BioRxiv, Dec. 4, 2016, 17 pages.

Garneau, et al., "The CRISPR/Cas Bacterial Immune System Cleaves Bacteriophage and Plasmid DNA", Nature, vol. 468, Nov. 4, 2010, 67-71.

Gasiunas, et al., "Cas9-CrRna Ribonucleoprotein Complex Mediates Specific DNA Cleavage for Adaptive Immunity In Bacteria", Proceedings of the National Academy of Sciences, vol. 109, No. 39, Sep. 25, 2012, 2579-2586.

Gootenberg, et al., "Nucleic Acid Detection with CRISPR-Cas13a/C2c2", Science, vol. 356, No. 6336, Apr. 28, 2017, 5 pages.

He, et al., "Knock-in of Large Reporter Genes in Human Cells via CRISPR/Cas9-induced Homology-dependent and Independent DNA Repair", Nucleic Acids Research, vol. 44, No. 9, May 19, 2016, 14 pages.

Hsu, et al., "DNA Targeting Specificity of Rna-Guided Cas9 Nucleases", Nature Biotechnology, vol. 31, No. 9, Sep. 2013, 827-832.

Hur, et al., "Targeted Mutagenesis in Mice by Electroporation of Cpf1 Ribonucleoproteins", Nature Biotechnology, vol. 34, No. 8, Aug. 2016, 807-808.

Jiang, et al., "RNA-Guided Editing of Bacterial Genomes Using CRISPR-Cas Systems", Nature Biotechnology, vol. 31, No. 3, Mar. 2013, 233-239.

Jinek, et al., "A Programmable Dual-RNA-Guided DNA Endonuclease in Adaptive Bacterial Immunity", Science, vol. 337, No. 6096, Aug. 17, 2012, 816-821.

(56) References Cited

OTHER PUBLICATIONS

Konermann, et al., "Genome-Scale Transcriptional Activation by an Engineered CRISPR-Cas9 Complex", Nature, vol. 517, No. 7536, Jan. 29, 2015, 583-588.
Leenay, et al., "Identifying and Visualizing Functional PAN Diversity across Crispr-Cas Systems", Molecular Cell, vol. 62, No. 1, Apr. 7, 2016, 137-147.
Lewis, et al., "Building the Class 2 CRISPR-Cas Arsenal", Molecular Cell, vol. 65, No. 3, Feb. 2, 2017, 377-379.
Liu, et al., "C2c1-sgRNA Complex Structure Reveals RNA-Guided DNA Cleavage Mechanism", Molecular Cell, vol. 65, No. 2, Jan. 2017, 310-322.
Maresca, et al., "Obligate Ligation-Gated Recombination (ObLiGaRe): Custom-designed Nuclease-mediated Targeted Integration through Nonhomologous End Joining", Genome Research, vol. 23, Mar. 2013, 539-546.
Port, et al., "Expansion of the CRISPR Toolbox in an Animal with tRNA-Flanked Cas9 and Cpf1 gRNAs", Biorxiv Reprint, Port and Bullock, Mar. 31, 2016, 10 pages.
Shmakov, et al., "Discovery and Functional Characterization of Diverse Class 2 CRISPR-Cas Systems", Molecular Cell, vol. 60, No. 3, Nov. 5, 2015, 385-397.
Shmakov, et al., "Diversity and Evolution of Class 2 CRISPR-Cas Systems", Nature Reviews Microbiology, vol. 15, No. 3, Mar. 2017, 30 pages.
Suzuki, et al., "In Vivo Genome Editing Via CRISPR/Cas9 Mediated Homology-Independent Targeted Integration", Nature, vol. 540, Dec. 2016, 144-149.
Teng, et al., "Repurposing CRISPR-Cas12b for Mammalian Genome Engineering", Cell Discovery, vol. 4, No. 63, Nov. 27, 2018, 15 pages.
Wu, et al., "Structural Basis of Stringent PAM Recognition by CRISPR-C2c1 in Complex with sgRNA", Cell Research, vol. 27, Apr. 4, 2017, 4 pages.
Yang, et al., "PAM-Dependent Target DNA Recognition and Cleavage by C2c1 CRISPR-Cas Endonuclease", Cell, vol. 167, No. 7, Dec. 15, 2016, 1814-1828.
Zetsche, et al., "Cpf1 is a Single RNA-Guided Endonuclease of a Class 2 CRISPR-Cas System", Cell, vol. 163, No. 3, Oct. 22, 2015, 759-771.
Zhang, et al., "Efficient Precise Knockin with a Double Cut HDR Donor after Crispr/Cas9-Mediated Double-Stranded DNA Cleavage", Genome Biology, vol. 18, No. 1, Feb. 20, 2017, 18 pages.
Zheng, et al., "DNA Editing in DNA/RNA Hybrids by Adenosine Deaminases that Act on RNA", Nucleic Acids Research, vol. 45, No. 6, Jan. 28, 2017, 3369-3377.
The Broad Institute, Inc., Rejection Decision for Chinese Patent Application No. 201980063325.5, mailed May 24, 2024, 16 pages.
The Broad Institute, Inc., Office Action for Canadian Patent Application No. 3,106,035, mailed Nov. 14, 2024, 7 pages.
Seuylemezian, A. et al., "hypothetical protein CU633_15260 [*Bacillus* sp. V3-13]", NCBI Protein, Accession PLR76547, Version PLR76547.1, Jan. 4, 2018 (Apr. 1, 2018).
The Broad Institute, Inc., Examination Report No. 1 for standard Patent application for Australian Patent Application No. 2019318079, mailed Nov. 14, 2024, 6 pages.
The Broad Institute, Inc., Notice of Grounds for Rejection for Korean Patent Application No. 10-2021-7004081, mailed Nov. 22, 2024, 12 pages.
The Broad Institute, Inc., Examination report No. 2 for standard patent application for Australian Patent Application No. 2019318079, Apr. 8, 2025, 8 pages.
The Broad Institute, Inc., Communication pursuant to Article 94(3) EPC for European Patent Application No. 19761994.3, 8 pages, Mar. 30, 2026.

* cited by examiner pZ49_pCDNA3-BhCas12b
8912 bp

C b

| position: | 641 | 749 | 846 | 893 | 837 | 905 | 915 |
|---|---|---|---|---|---|---|---|
| BhCas12b WT | K | R | K | S | E | F | L |
| BhCas12b v4 | K | R | R | R | G | F | L |
| BvCas12b | Q635 | D748 | R849 | H896 | D841 | I914 | I919 |

c d e f

Removal of C-terminal domain exposes ssDNA for potential base editing

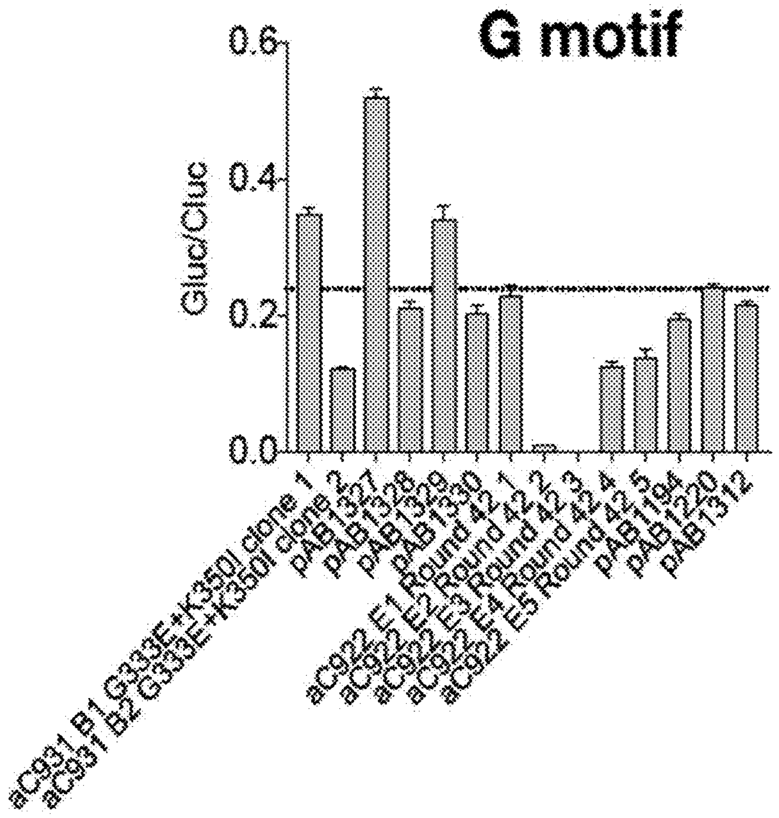
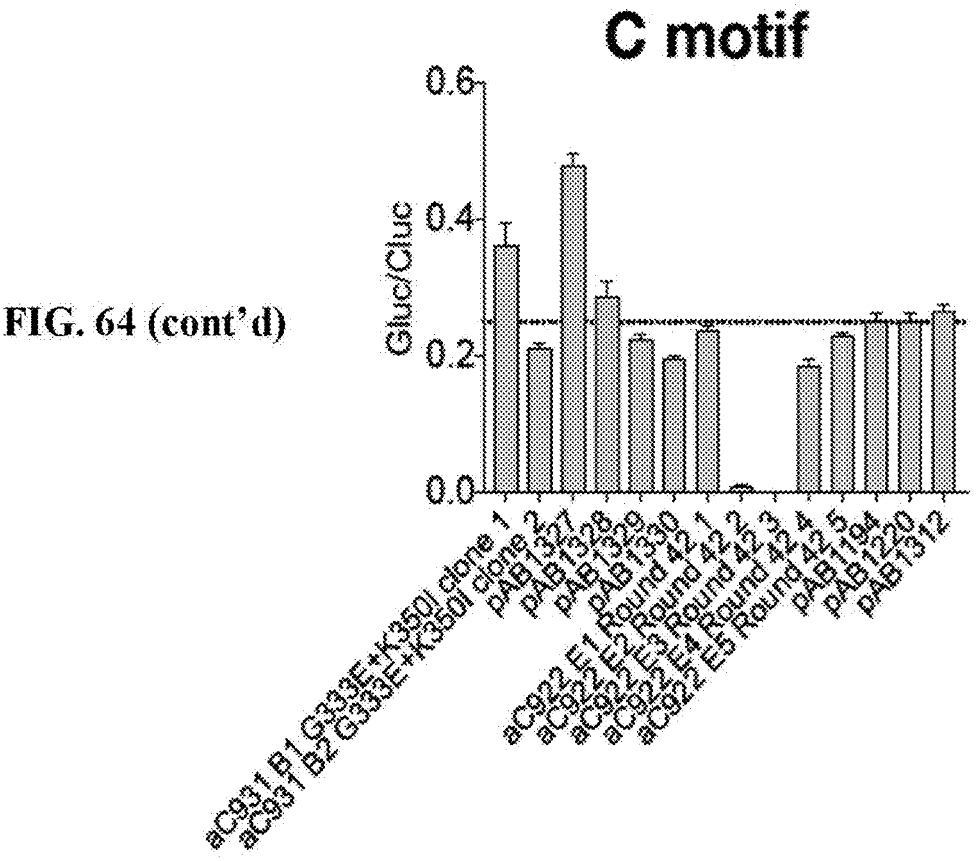
FIG. 64 (cont'd)

| RESCUE Round | ADAR mutations | Plasmid |
|---|---|---|
| RESCUEv0 | E488Q | pAB0048 |
| RESCUEv1 | E488Q, V351G | pAB0359 |
| RESCUEv2 | E488Q, V351G, S486A | pAB1188 |
| RESCUEv3 | E488Q, V351G, S486A, T375S | pAB0642 |
| RESCUEv4 | E488Q, V351G, S486A, T375S, S370C, | pAB1072 |
| RESCUEv5 | E488Q, V351G, S486A, T375S, S370C, P462A | pAB1135 |
| RESCUEv6 | E488Q, V351G, S486A, T375S, S370C, P462A, N597I | pAB1146 |
| RESCUEv7 | E488Q, V351G, S486A, T375S, S370C, P462A, N597I, L332I | pAB1194 |
| RESCUEv8 | E488Q, V351G, S486A, T375S, S370C, P462A, N597I, L332I, I398V | pAB1220 |
| RESCUEv9 | E488Q, V351G, S486A, T375S, S370C, P462A, N597I, L332I, I398V, K350I | pAB1327 |
| RESCUEv10 | E488Q, V351G, S486A, T375S, S370C, P462A, N597I, L332I, I398V, K350I, M383L | pAB1411 |
| RESCUEv11 | E488Q, V351G, S486A, T375S, S370C, P462A, N597I, L332I, I398V, K350I, M383L, D619G | pAB1491 |
| RESCUEv12 | E488Q, V351G, S486A, T375S, S370C, P462A, N597I, L332I, I398V, K350I, M383L, D619G, S582T | pAB1553 |

FIG. 69

Read Count per position

Bh∆966

| | A | C | C | A | G | A | G | A | T | A | A |
|---|---|---|---|---|---|---|---|---|---|---|---|
| A | 16784 | 160 | 44 | 16665 | 10 | 16667 | 10 | 16459 | 0 | 16766 | 16692 |
| C | 0 | 15563 | 15738 | 0 | 7 | 0 | 5 | 0 | 1 | 0 | 0 |
| G | 2 | 333 | 300 | 1 | 16694 | 1 | 16820 | 3 | 0 | 2 | 3 |
| T | 2 | 674 | 522 | 1 | 4 | 0 | 1 | 3 | 16780 | 0 | 0 |
| N | 142 | 200 | 326 | 263 | 215 | 262 | 94 | 465 | 149 | 161 | 234 |

Bh No Guide

| | A | C | C | A | G | A | G | A | T | A | A |
|---|---|---|---|---|---|---|---|---|---|---|---|
| A | 15540 | 1 | 1 | 15507 | 1 | 15528 | 0 | 15411 | 0 | 15579 | 15530 |
| C | 0 | 15534 | 15424 | 0 | 1 | 0 | 0 | 0 | 0 | 0 | 1 |
| G | 1 | 0 | 0 | 2 | 15504 | 1 | 15585 | 1 | 1 | 1 | 2 |
| T | 0 | 1 | 1 | 1 | 2 | 0 | 0 | 2 | 15590 | 0 | 0 |
| N | 129 | 134 | 244 | 160 | 162 | 141 | 85 | 256 | 79 | 90 | 137 |

FIG. 85

CAS12B ENZYMES AND SYSTEMS

CROSS-REFERENCE TO RELATED APPLICATIONS

This application is a national phase entry of International Application No. PCT/US2019/045582 filed Aug. 7, 2019, which claims the benefit of U.S. Provisional Application Nos. 62/715,640, filed Aug. 7, 2018, 62/744,080, filed Oct. 10, 2018, 62/751,196, filed Oct. 26, 2018, 62/794,929, filed Jan. 21, 2019, and 62/831,028, filed Apr. 8, 2019. The entire contents of the above-identified applications are hereby fully incorporated herein by reference.

STATEMENT REGARDING FEDERALLY SPONSORED RESEARCH

This invention was made with government support under Grant Nos. MH110049 and HL141201 awarded by the National Institutes of Health. The government has certain rights in the invention.

REFERENCE TO AN ELECTRONIC SEQUENCE LISTING

The contents of the electronic sequence listing ("BROD-2670US_ST25.txt"; Size is 880,124 bytes and it was created on Feb. 4, 2021) is herein incorporated by reference in its entirety.

TECHNICAL FIELD

The subject matter disclosed herein generally relates to systems, methods and compositions related to Clustered Regularly Interspaced Short Palindromic Repeats (CRISPR) and components thereof. The present invention also generally relates to delivery of large payloads and includes novel delivery particles, particularly using lipid and viral particle, and also novel viral capsids, both suitable to deliver large payloads, such as Clustered Regularly Interspaced Short Palindromic Repeats (CRISPR), CRISPR protein (e.g., Cas, C2c1), CRISPR-Cas or CRISPR system or CRISPR-Cas complex, components thereof, nucleic acid molecules, e.g., vectors, involving the same and uses of all of the foregoing, amongst other aspects. Additionally, the present invention relates to methods for developing or designing CRISPR-Cas system based therapy or therapeutics.

BACKGROUND

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

The CRISPR-Cas systems of bacterial and archaeal adaptive immunity show extreme diversity of protein composition and genomic loci architecture. The CRISPR-Cas system loci have more than 50 gene families and there is no strictly universal genes indicating fast evolution and extreme diversity of loci architecture. So far, adopting a multi-pronged approach, there is comprehensive Cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multi-subunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important. Novel Cas12b orthologues and uses thereof are desirable.

Citation or identification of any document in this application is not an admission that such document is available as prior art to the present invention.

SUMMARY

In one aspect, the present disclosure provides a non-naturally occurring or engineered system comprising i) a Cas12b effector protein from Table 1 or 2, and ii) guide comprising a guide sequence capable of hybridizing to a target sequence. In some embodiments, the system further comprises a tracr RNA.

In some embodiments, the Cas12b effector protein originates from a bacterium selected from the group consisting of: *Alicyclobacillus kakegawensis, Bacillus* sp. V3-13, *Bacillus hisashii, Lentisphaeria bacterium*, and *Laceyella sediminis*. In some embodiments, the tracr RNA is fused to the crRNA at the 5' end of the direct repeat. In some embodiments, the system comprises two or more crRNAs. In some embodiments, the guide sequence hybridizes to one or more target sequences in a prokaryotic cell. In some embodiments, the guide sequence hybridizes to one or more target sequences in a eukaryotic cell. In some embodiments, the Cas12b effector protein comprises one or more nuclear localization signals (NLSs). In some embodiments, the Cas12b effector protein is catalytically inactive. In some embodiments, the Cas12b effector protein is associated with one or more functional domains. In some embodiments, the one or more functional domains cleave the one or more target sequences. In some embodiments, the functional domain modifies transcription or translation of the one or more target sequences. In some embodiments, the Cas12b effector protein is associated with one or more functional domains; and the Cas12b effector protein contains one or more mutations within a RuvC and/or Nuc domain, whereby the formed CRISPR complex is capable of delivering an epigenetic modifier or a transcriptional or translational activation or repression signal at or adjacent to a target sequence. In some embodiments, the Cas12b effector protein is associated with an adenosine deaminase or cytidine deaminase. In some embodiments, the system further comprises a recombination template. In some embodiments, the recombination template is inserted by homology-directed repair (HDR).

In another aspect, the present disclosure provides a Cas12b vector system, which comprises one or more vectors comprising: a first regulatory element operably linked to a nucleotide sequence encoding a Cas12b effector protein from Table 1 or 2, and i) a) a second regulatory element operably linked to a nucleotide sequence encoding the guide sequence, and b) a third regulatory element operably linked to a nucleotide sequence encoding the tracr RNA, or ii) a second regulatory element operably linked to a nucleotide sequence encoding the guide sequence and the tracr RNA.

In some embodiments, the nucleotide sequence encoding the Cas12b effector protein is codon optimized for expression in a eukaryotic cell. In some embodiments, the system is comprised in a single vector. In some embodiments, the one or more vectors comprise viral vectors. In some embodiments, the one or more vectors comprise one or more retroviral, lentiviral, adenoviral, adeno-associated or herpes simplex viral vectors.

In another aspect, the present disclosure provides a delivery system configured to deliver a Cas12b effector protein and one or more nucleic acid components of a non-naturally occurring or engineered composition comprising i) Cas12b effector protein from Table 1 or 2, ii) a 3' guide sequence that is capable of hybridizing to one or more target sequences, and iii) a tracr RNA.

In some embodiments, the delivery system comprises one or more vectors, or one or more polynucleotide molecules, the one or more vectors or polynucleotide molecules comprising one or more polynucleotide molecules encoding the Cas12b effector protein and one or more nucleic acid components of the non-naturally occurring or engineered composition. In some embodiments, the delivery system comprises a delivery vehicle comprising liposome(s), particle(s), exosome(s), microvesicle(s), a gene-gun, or viral vector(s).

In another aspect, the present disclosure provides a non-naturally occurring or engineered system herein, a vector system herein, or a delivery system herein, for use in a therapeutic method of treatment.

In another aspect, the present disclosure provides a method of modifying one or more target sequences of interest, the method comprising contacting one or more target sequences with one or more non-naturally occurring or engineered compositions comprising i) a Cas12b effector protein from Table 1 or 2, ii) a 3' guide sequence that is capable of hybridizing to a target DNA sequence, and iii) a tracr RNA, whereby there is formed a CRISPR complex comprising the Cas12b effector protein complexed with the crRNA and the tracr RNA, wherein the guide sequence directs sequence-specific binding to the one or more target sequences in a cell, whereby expression of the one or more target sequences is modified. In some embodiments, modifying expression of the target gene comprises cleaving the one or more target sequences. In some embodiments, modifying expression of the target gene comprises increasing or decreasing expression of the one or more target sequences. In some embodiments, the composition further comprises a recombination template, and wherein modifying the one or more target sequences comprises insertion of the recombination template or a portion thereof. In some embodiments, the one or more target sequences is in a prokaryotic cell. In some embodiments, the one or more target sequences is in a eukaryotic cell.

In another aspect, the present disclosure provides a cell, or progeny thereof, comprising one or more modified target sequences, wherein the one or more target sequences have been modified according to the method herein, optionally a therapeutic T cell or antibody-producing B-cell or wherein said cell is a plant cell. In some embodiments, the cell is a prokaryotic cell. In some embodiments, the cell is a eukaryotic cell. In some embodiments, the modification of the one or more target sequences results in: the cell comprising altered expression of at least one gene product, wherein the expression of the at least one gene product is increased; the cell comprising altered expression of at least one gene product, wherein the expression of the at least one gene product is decreased; a cell or population that produces and/or secretes an endogenous or non-endogenous biological product or chemical compound. In some embodiments, the cell is a mammalian cell or a human cell. In another aspect, the present disclosure provides a cell line comprising the cell herein, or progeny thereof.

In another aspect, the present disclosure provides a multicellular organism comprising one or more cells herein.

In another aspect, the present disclosure provides a plant or animal model comprising one or more cells herein.

In another aspect, the present disclosure provides a gene product from a cell, a cell line, an organism, or a plant, or an animal model herein. In some embodiments, the amount of gene product expressed is greater than or less than the amount of gene product from a cell that does not have altered expression.

In another aspect, the present disclosure provides an isolated Cas12b effector protein from Table 1 or 2.

In another aspect, the present disclosure provides an isolated nucleic acid encoding the Cas12b effector protein. In some embodiments, the isolated nucleic acid is a DNA and further comprises a sequence encoding a crRNA and a tracr RNA.

In another aspect, the present disclosure provides an isolated eukaryotic cell comprising the nucleic acid herein or Cas12b protein.

In another aspect, the present disclosure provides non-naturally occurring or engineered systems comprising i) an mRNA encoding a Cas12b effector protein from Table 1 or 2, ii) a guide sequence, and iii) a tracr RNA. In some embodiments, the tracr RNA is fused to the crRNA at the 5' end of the direct repeat.

In another aspect, the present disclosure provides an engineered system for site directed base editing comprising a targeting domain and an adenosine deaminase, cytidine deaminase, or catalytic domain thereof, wherein the targeting domain comprises a Cas12b effector protein, or fragment thereof, which retains oligonucleotide-binding activity and a guide molecule. In some embodiments, the Cas12b effector protein is catalytically inactive. In some embodiments, the Cas12b effector protein is selected from Table 1 or 2. In some embodiments, the Cas12b effector protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

In another aspect, the present disclosure provides a method of modifying an adenosine or cytidine in one or more target oligonucleotides of interest, comprising delivering to said one or more target oligonucleotides the composition herein. In some embodiments, the method is for use in the treatment or prevention of a disease caused by transcripts containing a pathogenic T→C or A→G point mutation. In another aspect, the present disclosure provides an isolated cell obtained from the method herein and/or comprising the composition herein. In some embodiments, said eukaryotic cell being preferably a human or non-human animal cell, optionally a therapeutic T cell or antibody-producing B-cell, or wherein said cell is a plant cell.

In another aspect, the present disclosure provides a non-human animal comprising said modified cell or progeny thereof.

In another aspect, the present disclosure provides a plant comprising the modified cell herein.

In another aspect, the present disclosure provides modified cells for use in therapy, preferably cell therapy.

In another aspect, the present disclosure provides a method of modifying an adenine or cytosine in a target oligonucleotide, comprising delivering to said target oligonucleotide: a catalytically inactive Cas12b protein; a guide molecule, which comprises a guide sequence linked to a direct repeat; and an adenosine or cytidine deaminase protein or catalytic domain thereof, wherein said adenosine or cytidine deaminase protein or catalytic domain thereof is covalently or non-covalently linked to said catalytically inactive Cas12b protein or said guide molecule, or is adapted to linked thereto after delivery, wherein said guide molecule forms a complex with said catalytically inactive Cas12b and directs said complex to bind said target oligonucleotide, wherein said guide sequence is capable of hybridizing with a target sequence within said target oligonucleotide to form an oligonucleotide duplex.

In some embodiments, (A) said Cytosine is outside said target sequence that forms said oligonucleotide duplex, wherein said cytidine deaminase protein or catalytic domain thereof deaminates said Cytosine outside said RNA duplex, or (B) said Cytosine is within said target sequence that forms said RNA duplex, wherein said guide sequence comprises a non-pairing Adenine or Uracil at a position corresponding to said Cytosine resulting in a C-A or C-U mismatch in said oligonucleotide duplex, and wherein the cytidine deaminase protein or catalytic domain thereof deaminates the Cytosine in the oligonucleotide duplex opposite to the non-pairing Adenine or Uracil. In some embodiments, said adenosine deaminase protein or catalytic domain thereof deaminates said Adenine or Cytosine in the oligonucleotide duplex. In some embodiments, the Cas12b effector protein is selected from Table 1 or 2. In some embodiments, the Cas12b protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

In another aspect, the present disclosure provides a system for detecting the presence of nucleic acid target sequences in one or more in vitro samples, comprising: a Cas12b protein; at least one guide polynucleotide comprising a guide sequence designed to have a degree of complementarity with the target sequence, and designed to form a complex with the Cas12b; and an oligonucleotide-based masking construct comprising a non-target sequence, wherein the Cas12b exhibits collateral nuclease activity and cleaves the non-target sequence of the oligo-nucleotide based masking construct once activated by the target sequence.

In another aspect, the present disclosure provides a system for detecting the presence of one or more target polypeptides in one or more in vitro samples comprising: a Cas12b protein; one or more detection aptamers, each designed to bind to one of the one or more target polypeptides, each detection aptamer comprising a masked promoter binding site or masked primer binding site and a trigger sequence template; and an oligonucleotide-based masking construct comprising a non-target sequence.

In some embodiments, the system further comprises nucleic acid amplification reagents to amplify the target sequence or the trigger sequence. In some embodiments, the nucleic acid amplification reagents are isothermal amplification reagents. In some embodiments, the Cas12b protein is selected from Table 1 or 2. In some embodiments, the Cas12b effector protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

In another aspect, the present disclosure provides a method for detecting nucleic acid sequences in one or more in vitro samples, comprising: contacting one or more samples with: i) a Cas12b protein; ii) at least one guide polynucleotide comprising a guide sequence designed to have a degree of complementarity with the target sequence, and designed to form a complex with the Cas12b protein; and iii) an oligonucleotide-based masking construct comprising a non-target sequence, and wherein said Cas12b protein exhibits collateral nuclease activity and cleaves the non-target sequence of the oligo-nucleotide-based masking construct.

In some embodiments, the Cas12b protein is selected from Table 1 or 2. In some embodiments, the Cas12b protein originates from a bacterium selected from the group consisting of: *Alicyclobacillus kakegawensis, Bacillus* sp. V3-13, *Bacillus hisashii, Lentisphaeria bacterium*, and *Laceyella sediminis*. In another aspect, the present disclosure provides a non-naturally occurring or engineered composition comprising a Cas12b protein linked to an inactive first portion of an enzyme or reporter moiety, wherein the enzyme or reporter moiety is reconstituted when contacted with a complementary portion of the enzyme or reporter moiety. In some embodiments, the enzyme or reporter moiety comprises a proteolytic enzyme. In some embodiments, the Cas12b protein comprises a first Cas12b protein and a second Cas12b protein linked to the complementary portion of the enzyme or reporter moiety. In some embodiments, the composition further comprises: i) a first guide capable of forming a complex with the first Cas12b protein and hybridizing to a first target sequence of a target nucleic acid; and ii) a second guide capable of forming a complex with the second Cas12b protein and hybridizing to a second target sequence on the target nucleic acid. In some embodiments, the proteolytic enzyme comprises a caspase. In some embodiments, the proteolytic enzyme comprises tobacco etch virus (TEV).

In another aspect, the present disclosure provides a method of providing a proteolytic activity in a cell containing a target oligonucleotide, comprising: a) contacting a cell or population of cells with: i) a first Cas12b effector protein linked to an inactive portion of a proteolytic enzyme; ii) a second Cas12b effector protein linked to a complementary portion the proteolytic enzyme, wherein proteolytic activity of the proteolytic enzyme is reconstituted when the first portion and the complementary portion of the proteolytic enzyme are contacted; iii) a first guide that binds to the first Cas12b effector protein and hybridizes to a first target sequence of the target oligonucleotide; and iv) a second guide that binds to the second Cas12b effector protein and hybridizes to a second target sequence of the target oligonucleotide, whereby the first portion and a complementary portion of the proteolytic enzyme are contacted and the proteolytic activity of the proteolytic enzyme is reconstituted.

In some embodiments, the proteolytic enzyme is a caspase. In some embodiments, the proteolytic enzyme is TEV protease, wherein the proteolytic activity of the TEV protease is reconstituted, whereby a TEV substrate is cleaved and activated. In some embodiments, the TEV substrate is a procaspase engineered to contain TEV target sequences whereby cleavage by the TEV protease activates the procaspase.

In another aspect, the present disclosure provides a method of identifying a cell containing an oligonucleotide of interest, the method comprising contacting the oligonucleotide in the cell with a composition which comprises: i) a first Cas12b effector protein linked to an inactive first portion of a proteolytic enzyme; ii) a second Cas12b effector protein linked to a complementary portion of the proteolytic enzyme wherein activity of the proteolytic enzyme is reconstituted when the first portion and the complementary portion of the proteolytic enzyme are contacted; iii) a first guide that binds to the first Cas12b effector protein and hybridizes to a first target sequence of the oligonucleotide; iv) a second guide that binds to the second Cas12b effector protein and hybridizes to a second target sequence of the oligonucleotide; and v) a reporter which is detectably cleaved, wherein the first portion and a complementary portion of the proteolytic enzyme are contacted when the oligonucleotide of interest is present in the cell, whereby the activity of the proteolytic enzyme is reconstituted and detectably cleaves the reporter.

In another aspect, the present disclosure provides a method of identifying a cell containing an oligonucleotide of interest, the method comprising contacting the oligonucleotide in the cell with a composition which comprises: i) a first Cas12b effector protein linked to an inactive first portion of a reporter; ii) a second Cas12b effector protein linked to a complementary portion of the reporter, wherein activity of the reporter is reconstituted when the first portion and the complementary portion of the reporter are contacted; iii) a first guide that binds to the first Cas12b effector protein and hybridizes to a first target sequence of the oligonucleotide; iv) a second guide that binds to the second Cas12b effector protein and hybridizes to a second target sequence of the oligonucleotide; and v) the reporter, wherein the first portion and a complementary portion of the reporter are contacted when the oligonucleotide of interest is present in the cell, whereby the activity of the reporter is reconstituted. In some embodiments, the reporter is a fluorescent protein or a luminescent protein.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

(FIG. 15A—SEQ ID NO: 30 and 657; FIG. 15B—SEQ ID NO: 31 and 658; FIG. 15C—SEQ ID NO: 32 and 659).

(FIG. 17A—SEQ ID NO: 33 and 660; FIG. 17B—SEQ ID NO: 34 and 661; FIG. 17C—SEQ ID NO: 35; FIG. 17D—SEQ ID NO: 36; FIG. 17E—SEQ ID NO: 37)

(FIG. 22A—SEQ ID NO: 38 and 662; FIG. 22B—SEQ ID NO: 39; FIG. 22C—SEQ ID NO: 40; FIG. 22D—SEQ ID NO: 41)

FIG. 44A) Locus schematics and protein domain structure highlighting the differences between Cas9, Cas12a, and Cas12b nucleases. Crystal structures of SpCas9 (PDB: 4008), AsCas12a (PDB:5b43), and AacCas12b (PDB:5u30). FIG. 44B) In vitro reconstitution of Cas12b systems with purified Cas12b protein and synthesized crRNA and tracrRNA identified through RNA-Seq. Reactions were carried out at the indicated temperatures for 90 min and 250 nM Cas12b protein. FIG. 44C, FIG. 44D) AkCas12b and BhCas12b indel activity in 293T cells with six sgRNA variants. Error bars represent s.d. from n=4 replicates. See FIGS. 50B and 50C for sgRNA sequences. FIG. 44E) Schematic of BhCas12b sgRNA structure and the location of tested variants (SEQ ID NO: 78).

FIG. 45A) In vitro Cas12b reactions with differentially labelled DNA strands. A slower migrating product is observed during native PAGE separation and separation by denaturing PAGE reveals a preference for AkCas12b and BhCas12b to cut the non-target strand at lower temperatures. FIG. 45B) Location of 10 of the 12 tested residues in the pocket between the target strand and the RuvC active site (purple). BhCas12b residues are highlighted in the structure of the highly similar BthCas12b (PDB: 5wti).

FIG. 45C) Indel activity of 268 BhCas12b mutations at DNMT1 target 4 and VEGFA target 2 normalized to wild-type (grey symbols). Error bars represent s.d. from n=2 replicates. FIG. 45D) Location of surface exposed residues mutated to glycine. FIG. 45E) Indel activity of 66 BhCas12b mutations at DNMT1 target 4 and VEGFA target 2 normalized to wild-type (grey symbols). Error bars represent s.d. from n=2 replicates. FIG. 45F) Summary of BhCas12b hyperactive variants. FIG. 45G) Indel activity of BhCas12b variants at 4 target sites. Error bars represent s.d. from n=3-6 replicates. FIG. 45H) In vitro cleavage with increasing concentrations of BhCas12b WT and v4 variant. Gel is representative image from n=2 experiments.

FIG. 46A) Indel activity in 293T cells of AsCpf1 at 28 TTTV targets, BhCas12b v4 at 33 ATTN targets, and BvCas12b at 37 ATTN targets. Each dot represents a single target site, averaged from n=4 replicates. FIG. 46B) Average indel length from Cas12b genome editing averaged from 30 active guides. FIG. 46C) Schematic of a DNMT1 target site targetable by SpCas9 and Cas12a/b nucleases and a 120 nt ssODN donor containing a TG to CA mutation and PAM disrupting mutations (SEQ ID NO: 79-83). FIG. 46D) Indel activity of each nuclease at the locus. Error bars represent s.d. from n=8 replicates. FIG. 46E) Frequency of homology-directed repair (HDR) using a target strand (T) or non-target strand (NT) donor. Grey bars indicate the frequency of TG to CA mutation, while red bars indicate perfect edits containing the HDR sequence in panel c with no mutations. Error bars represent s.d. from n=6 replicates. FIG. 46F) Average indel length during genome editing with 30 active BhCas12b guides, 45 active AsCas12a guides, and 39 active SpCas9 guides. FIG. 46G) Indel activity in CD4+ human T cells following BhCas12b v4 RNP delivery. Each dot represents an individual electroporation (n=2). Source data are provided as a Source Data file.

FIG. 47A) Indel activity in 293T cells at 9 target sites selected for Guide-Seq analysis. Error bars represent s.d. from n=4 replicates. FIG. 47B) Guide-Seq analysis showing the number and relative proportion of detected cleavage site sites for each nuclease. Off-targets are shown as light grey wedges while the on-target site is highlighted in blue with the fraction of on-target reads shown below. Off-targets were only detected with SpCas9, see FIG. 55 for full analysis.

FIG. 48A) Alignment of Cas12b orthologs. FIG. 48B) Phylogenetic tree of the subtype V-B effector Cas12b proteins based on the alignment. Sequences are denoted by Genbank protein accession number and species name. The proteins that were experimentally studied in this work are shown in bold. The four proteins that showed robust editing activity at 37° C. and were studied in detail are underlined. FIG. 48C) Schematic of the PAM discovery assay in *E. coli*. FIG. 48D) Depleted PAMs were detected in only 4 out of 14 Cas12b systems in *E. coli*. A depletion threshold was set at a $-\log_2$ ratio of 3.32 (dotted line) except for EbCas12b which had a threshold set at 2.32. Depleted PAMs are shown as sequence motifs as well as PAM wheels[22] starting in the middle of the wheel for the first 5' base exhibiting sequence information. FIG. 48E) Phylogenetic tree of the subtype V-B effector Cas12b proteins. Sequences are denoted by Genbank protein accession number and species name. The proteins that were experimentally studied in this work are highlighted in blue.

FIGS. 49A-49D) Alignment of small RNA-Seq reads for AkCas12b, BhCas12b, EbCas12b, and LsCas12b. The location of the tracrRNA used in cleavage reactions is highlighted in yellow. FIG. 49E) Coomassie stained SDS-PAGE gel of purified Cas12b proteins used in this study and commercially produced AsCas12a (IDT). FIG. 49F) In vitro cleavage reactions with AkCas12b and BhCas12b comparing tracrRNA and crRNA to v1 sgRNA scaffolds.

FIG. 50A) Schematic of expression constructs and assay for indel activity in mammalian cells. FIG. 50B) AkCas12b sgRNA variants (SEQ ID NO: 84-89). FIG. 50C) BhCas12b sgRNA variants (SEQ ID NO: 90-95). FIG. 50D) Schematic of AkCas12b sgRNA structure and the location of tested variants (SEQ ID NO: 96). FIG. 50E) Indel activity in 293T cells with BhCas12b and varying spacer lengths. Error bars represent s.d. from n=2 replicates.

FIG. 51A) Comparison of indel activity between BhCas12b and the highly similar BthCas12b in 293T cells. Error bars represent s.d. from n=2 replicates. FIG. 51B-FIG. 51E) Indel activity of BhCas12b mutant combinations at DNMT1 target 4 and VEGFA target 2. Error bars represent s.d. from a minimum of n=2 replicates. FIG. 51F) BhCas12b v4 mutations modeled into the structure of BthCas12b using Pymol (Schrodinger). FIG. 51G) Coomassie stained SDS-PAGE gel of purified BhCas12b WT and v4 protein. FIG. 51H) In vitro cleavage time-course with BhCas12b WT and v4 variant. Gel is representative image from n=3 experiments. FIG. 51I, FIG. 51J) Quantitation of dsDNA cleavage products (FIG. 51I) and upper nicked product (FIG. 51J) from the reactions shown in panel h. Error bars represent s.d. from n=3 experiments.

FIG. 52A) PAM discovery as described in FIGS. 48C and 48D. FIG. 52B) Alignment of small RNA-Seq reads for BvCas12b. The location of the tracrRNA used in cleavage reactions is highlighted in yellow. FIGS. 52C-52D) In vitro reconstitution of BvCas12 with purified protein and synthesized RNA reactions were carried out at the indicated temperatures for 90 min and 250 nM BvCas12b protein. FIG. 52E) Coomassie stained SDS-PAGE gel of purified BvCas12b. FIG. 52F) BvCas12b sgRNA variants (SEQ ID NO: 97-102). FIG. 52G) Schematic of BvCas12b sgRNA structure and the location of tested variants (SEQ ID NO: 103). FIG. 52H) BvCas12b indel activity in 293T cells with sgRNA variants. Error bars represent s.d. from n=4 replicates. FIG. 52I) BvCas12b indel activity in 293T cells at 57 targets. Each dot represents a single target site, averaged from n=4 replicates. FIG. 52J) Correlation of BhCas12b v4 and BvCas12b activity at matched target sites. Source data are provided as a Source Data file.

FIG. 53A) Alignment of BhCas12b positions in the target-strand identified in highlighted positions and their corresponding amino acid in BvCas12b. FIG. 53B) In vitro BvCas12b reactions with differentially labelled DNA strands as described in FIG. 45A. FIG. 53C) Indel activity of 79 BvCas12b mutations targeting residues Q635, D748, R849, H896, T909, I914 and I919. Indels were measured at DNMT1 target 6 and VEGFA target 5 normalized to wild-type (grey symbols). Error bars represent s.d. from n=2 replicates. FIGS. 53D-53E) Indel activity of BhCas12b mutations at DNMT1 target 6 and VEGFA target 5. Error bars represent s.d. from n=2 replicates.

FIG. 54A) Indel activity in 293T cells BhCas12b v4 at 56 targets, and BvCas12b at 57 targets across. Each dot represents a single target site, averaged from n=4 replicates. FIG. 54B) Correlation of BhCas12b v4 and BvCas12b activity at matched target sites. FIG. 54C) Analysis of PAM prevalence for Class 2 CRISPR-Cas nucleases. Probability mass function for the distance from each base within non-masked human coding sequences to the nearest Cas9 or Cas12 cleavage site. FIG. 54D) Schematic of a VEGFA target site targetable by SpCas9 and Cas12b nucleases and a 120 nt ssODN donor containing a TC to CA mutation and PAM disrupting mutations (SEQ ID NO: 104-108). FIG. 54E) Indel activity of each nuclease at the locus. Error bars represent s.d. from n=3 replicates. FIG. 54F) Frequency of homology-directed repair (HDR) using a target strand (T) or non-target strand (NT) donor. Grey bars indicate the frequency of TC to CA mutation, while blue bars indicate perfect edits containing the HDR sequence in panel d with no mutations. Error bars represent s.d. from n=3 replicates.

FIGS. 55B-55C) Cas12b indel activity in 293T cells when mismatches are present between the guide sgRNA and target DNA. Mismatches were inserted in the sgRNA to match the target strand (i.e., C to G, A to T). BhCas12b v4 was tested at DNMT1 target 6 and VEGFA target 2, while BvCas12b was tested at DNMT1 target 6 and VEGFA target 5. Error bars represent s.d. from n=4 replicates.

FIGS. 56A-56B. Specificity analysis of matched CRISPR-Cas nuclease targets. Full Guide-Seq analysis of detected off-targets in FIG. 47B. A list of detected cleavage sites (up to 20 per target) is presented for each nuclease with the on-target site denoted with a small box. Mismatches to the guide sequence are highlighted. Target 1: EMX1 (SEQ ID NO: 109-130); Target 2: EMX1 (SEQ ID NO: 131-152); Target 3: DNMT1 (SEQ ID NO: 153-174); Target 4: CXCR4 (SEQ ID NO: 175-176); Target 5: CXCR4 (SEQ ID NO: 178-181); Target 6: CXCR4 (SEQ ID NO: 182-186); Target 7: VEGFA (SEQ ID NO: 187-209); Target 8: GRIN2B (SEQ ID NO: 210-215); Target 9: CXCR4 (SEQ ID NO: 216-221); Target 10: HPRT1 (SEQ ID NO: 222-225).

FIG. 69 shows a summary of RESCUE mutations screened.

FIG. 82B) Guide-Seq analysis showing the number and relative proportion of detected cleavage sites for each nuclease. Off-targets are shown as light grey wedges while the on-target site is highlighted in purple (for SpCas9), dark blue (for BhCas12b v4), or light blue (for AsCas12a) with the fraction of on-target reads shown below. Off-targets were only detected with SpCas9. FIG. 82C) BhCas12b indel activity in 293T cells when mismatches are present between the guide sgRNA and target DNA. Mismatches were inserted in the sgRNA to match the target strand (i.e., C to G, A to T). Error bars represent s.d. from n=4 replicates.

FIG. 85—provides Cas12 base editing data in accordance with certain example embodiments.

FIGS. 88B and 88C demonstrate the transduction of rat neurons with AAV1/2 expressing BhCas12b v4 or BhCas12b.

FIG. 89B shows a map of px602-bv-optimize-AAV (SEQ ID NO: 665).

Figure 1:
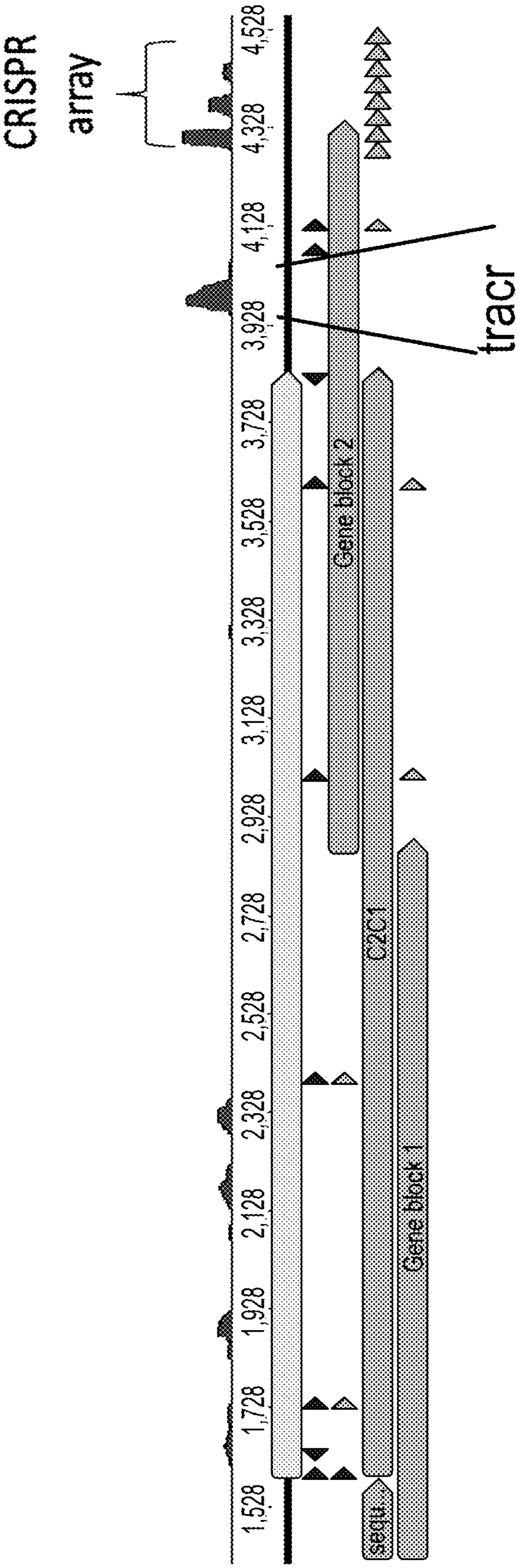
FIG. 1 depicts the *Phycisphaerae bacterium* CRISPR-C2c1 locus. Small RNAseq revealed the location of the tracrRNA and the architecture of the mature crRNAs.

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance, or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar as such variations are appropriate to perform in the disclosed invention. It is to be understood that the value to which the modifier "about" or "approximately" refers is itself also specifically, and preferably, disclosed.

The term "exemplary" is used herein to mean serving as an example, instance, or illustration. Any aspect or design described herein as "exemplary" is not necessarily to be construed as preferred or advantageous over other aspects, embodiments, or designs.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, and/or cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment," "an embodiment," "an example embodiment," means that a particular feature, structure, or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment but may. Furthermore, the particular features, structures or characteristics may be combined in any suitable manner, as would be apparent to a person skilled in the art from this disclosure, in one or more embodiments. Furthermore, while some embodiments described herein include some, but not other, features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

In one aspect, embodiments disclosed herein are directed to engineered or isolated CRISPR-Cas effector proteins and orthologs. In particular, the invention relates to Cas12b effector proteins and orthologs. As used herein, the term Cas12b is used interchangeably with C2c1. The invention further relates to CRISPR-Cas systems comprising such orthologs, as well as polynucleotide sequences encoding such orthologs or systems and vectors or vector systems comprising such and delivery systems comprising such. The invention further relates to cells or cell lines or organisms comprising such Cas12b proteins, CRISPR-Cas systems, polynucleic acid sequences, vectors, vector systems, and delivery systems. The invention further relates to medical and non-medical uses of such proteins, CRISPR-Cas systems, polynucleic acid sequences, vectors, vector systems, delivery systems, cells, cell lines, etc. In another aspect, embodiments disclosed herein are directed to engineered CRISPR-Cas effector proteins that comprise at least one modification compared to an unmodified CRISPR-Cas effector protein that enhances binding of the CRISPR complex to the binding site and/or alters editing preference as compared to wild type. In certain embodiments, the CRISPR-Cas effector protein is a Type V effector protein, preferably a Type V-B. In certain other example embodiments, the Type V-B effector protein is C2c1. Example C2c1 proteins suitable for use in the embodiments disclosed herein are discussed in further detail below. In another aspect, embodiments disclosed are directed to engineered CRISPR-Cas systems comprising engineered guides. As used herein, the term CRISPR effector or CRISPR protein or Cas (protein or effector) is used interchangeably with Cas12b protein or effector and may be a mutated (such as comprising point mutation(s) and/or truncations) or wild type protein.

In some examples, the present disclosure provides for a non-naturally occurring or engineered system comprising i) a Cas12b effector protein from Table 1 or 2, ii) a crRNA comprising a) a 3' guide sequence that is capable of hybridizing to one or more target sequences, in certain embodiments, one or more target DNA sequences, and b) a 5' direct repeat sequence, and iii) a tracr RNA, whereby there is formed a CRISPR complex comprising the Cas12b effector protein complexed with the crRNA and the tracr RNA.

In some examples, the present disclosure provides a non-naturally occurring or engineered system comprising i) a Cas12b effector protein from Table 1 or 2, and ii) a guide comprising a guide sequence capable of hybridizing to a target sequence. In some cases, the system further comprises a tracrRNA.

In another aspect, embodiments disclosed herein are directed to vectors for delivery of CRISPR-Cas effector proteins, including C2c1. In certain example embodiments, the vectors are designed so as to allow packaging of the CRISPR-Cas effector protein within a single vector. There is also an increased interest in the design of compact promoters for packing and thus expressing larger transgenes for targeted delivery and tissue-specificity. Thus, in another aspect, certain embodiments disclosed herein are directed to delivery vectors, constructs, and methods of delivering larger genes for systemic delivery.

In another aspect, the present invention relates to methods for developing or designing CRISPR-Cas systems. In an aspect, the present invention relates to methods for developing or designing optimized CRISPR-Cas systems for a wide range of applications including, but not limited to, therapeutic development, bioproduction, and plant and agricultural applications. The present invention in particular relates to methods for improving CRISPR-Cas systems, such as CRISPR-Cas system based therapy or therapeutics. Key characteristics of successful CRISPR-Cas systems, such as CRISPR-Cas system based therapy or therapeutics, involve high specificity, high efficacy, and high safety. High specificity and high safety can be achieved among others by reduction of off-target effects. Improved specificity and efficacy likewise may be used to improve applications in plants and bioproduction.

Accordingly, in an aspect, the present invention relates to methods for increasing specificity of CRISPR-Cas systems, such as CRISPR-Cas system based therapy or therapeutics. In a further aspect, the invention relates to methods for increasing efficacy of CRISPR-Cas systems, such as CRISPR-Cas system based therapy or therapeutics. In a further aspect, the invention relates to methods for increasing safety of CRISPR-Cas systems, such as CRISPR-Cas system based therapy or therapeutics. In a further aspect, the present invention relates to methods for increasing specificity, efficacy, and/or safety, preferably all, of CRISPR-Cas systems, such as CRISPR-Cas system based therapy or therapeutics.

In certain embodiments, the CRISPR-Cas system comprises a CRISPR effector as defined herein elsewhere.

The methods of the present invention in particular involve optimization of selected parameters or variables associated with the CRISPR-Cas system and/or its functionality, as described herein further elsewhere. Optimization of the CRISPR-Cas system in the methods as described herein may depend on the target(s), such as the therapeutic target or therapeutic targets, the mode or type of CRISPR-Cas system modulation, such as CRISPR-Cas system based therapeutic target(s) modulation, modification, or manipulation, as well as the delivery of the CRISPR-Cas system components. One or more targets may be selected, depending on the genotypic and/or phenotypic outcome. For instance, one or more therapeutic targets may be selected, depending on (genetic) disease etiology or the desired therapeutic outcome. The (therapeutic) target(s) may be a single gene, locus, or other genomic site, or may be multiple genes, loci or other genomic sites. As is known in the art, a single gene, locus, or other genomic site may be targeted more than once, such as by use of multiple gRNAs.

CRISPR-Cas system activity, such as CRISPR-Cas system design, may involve target disruption, such as target mutation, such as leading to gene knockout. CRISPR-Cas system activity, such as CRISPR-Cas system design may involve replacement of particular target sites, such as leading to target correction. CRISPR-Cas system design may involve removal of particular target sites, such as leading to target deletion. CRISPR-Cas system activity may involve modulation of target site functionality, such as target site activity or accessibility, leading, for instance, to (transcriptional and/or epigenetic) gene or genomic region activation or gene or genomic region silencing. The skilled person will understand that modulation of target site functionality may involve CRISPR effector mutation (such as, for instance, generation of a catalytically inactive CRISPR effector) and/or functionalization (such as, for instance, fusion of the CRISPR effector with a heterologous functional domain, such as a transcriptional activator or repressor), as described herein elsewhere. Accordingly, in another aspect, the invention relates to engineered compositions for site directed base editing comprising a modified CRISPR effector protein and functional domain(s). In an embodiment of the invention, there is RNA base-editing. In an embodiment of the invention, there is DNA base-editing. In certain embodiments, the functional domains comprise deaminases or catalytic domains thereof, including cytidine and adenosine deaminases. Example functional domains suitable for use in the embodiments disclosed herein are discussed in further detail below.

In certain example embodiments, an engineered CRISPR-Cas effector protein complexes with a nucleic acid comprising a guide sequence to form a CRISPR complex, and wherein, in the CRISPR complex, the nucleic acid molecule targets one or more polynucleotide loci and the protein comprises at least one modification compared to the unmodified protein that enhances binding of the CRISPR complex to the binding site and/or alters editing preferences as compared to wildtype. The editing preference may relate to indel formation. In certain example embodiments, the at least one modification may increase formation of one or more specific indels at a target locus. The CRISPR-Cas effector protein may be Type V CRISPR-Cas effector protein. In certain example embodiments, the CRISPR-Cas protein is C2c1, also known as Cas12b, or orthologue thereof.

The invention provides methods of genome editing or modifying sequences associated with or at a target locus of interest, wherein the method comprises introducing a C2c1 effector protein complex into any desired cell type, prokaryotic or eukaryotic cell, whereby the C2c1 effector protein complex effectively functions to integrate a DNA insert into the genome of the eukaryotic or prokaryotic cell. In preferred embodiments, the cell is a eukaryotic cell and the genome is a mammalian genome. In preferred embodiments, the integration of the DNA insert is facilitated by non-homologous end joining (NHEJ)-based gene insertion mechanisms. In preferred embodiments, the DNA insert is an exogenously introduced DNA template or repair template. In one preferred embodiment, the exogenously introduced DNA template or repair template is delivered with the C2c1 effector protein complex or one component or a polynucleotide vector for expression of a component of the complex. In a more preferred embodiment, the eukaryotic cell is a non-dividing cell (e.g., a non-dividing cell in which genome editing via HDR is especially challenging).

The invention also provides a method of modifying a target locus of interest, the method comprising delivering to said locus a non-naturally occurring or engineered composition comprising a C2c1 loci effector protein and one or more nucleic acid components, wherein the C2c1 effector protein forms a complex with the one or more nucleic acid components and, upon binding of the said complex to the locus of interest, the effector protein induces the modification of the target locus of interest. In one embodiment, the modification is the introduction of a strand break. The strand break can be followed by non-homologous end joining. In another embodiment, a repair template is provided and the break is followed by homologous recombination.

According to the invention, an enzyme that modifies a nucleic acid is provided. In one such embodiment, there is base editing of DNA. In another such embodiment, there is base editing of RNA. More particularly, the invention provides deaminases and deaminase variants capable of modifying a nucleobase in a cell. In one embodiment, a deaminase targets a mismatch in a DNA/RNA duplex and edits the mismatched DNA base of the target. In another embodiment, a deaminase targets a mismatch in a RNA/RNA duplex and edits the target RNA.

In such methods the target locus of interest may be comprised in a nucleic acid molecule within a cell. The cell may be a prokaryotic cell or a eukaryotic cell. The cell may be a mammalian cell. The mammalian cell may be a non-human primate, bovine, porcine, rodent or mouse cell. The cell may be a non-mammalian eukaryotic cell, such as poultry, fish or shrimp. The cell may also be a plant cell. The plant cell may be of a crop plant, such as cassava, corn, sorghum, wheat, or rice. The plant cell may also be of an algae, tree or vegetable. The modification introduced to the cell by the present invention may be such that the cell and progeny of the cell are altered for improved production of biologic products, such as an antibody, starch, alcohol or other desired cellular output. The modification introduced to the cell by the present invention may be such that the cell and progeny of the cell include an alteration that changes the biologic product produced.

In any of the described methods, the target locus of interest may be a genomic or epigenomic locus of interest. In any of the described methods, the complex may be delivered with multiple guides for multiplexed use. In any of the described methods, more than one protein(s) may be used.

CRISPR-Cas System

In general, the CRISPR system may be as used in the foregoing documents, such as WO 2014/093622 (PCT/US2013/074667), and refers collectively to transcripts and other elements involved in the expression of or directing the activity of CRISPR-associated ("Cas") genes, including sequences encoding a Cas gene, in particular a C2c1 gene, a tracr (trans-activating CRISPR) sequence (e.g., tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide C2c1, e.g., CRISPR RNA and transactivating (tracr) RNA or a single guide RNA (sgRNA) (chimeric RNA)), or other sequences and transcripts from a CRISPR locus.

In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. The CRISPR complex formed in embodiments comprising a Cas12b protein may comprise a complex with crRNA and tracrRNA, described elsewhere herein. The section of the guide sequence through which complementarity to the target sequence is important for cleavage activity is referred to herein as the seed sequence. A target sequence may comprise any polynucleotide, such as DNA or RNA polynucleotides. In some embodiments, a target sequence is located in the nucleus or cytoplasm of a cell, and may include nucleic acids in or from mitochondrial, organelles, vesicles, liposomes or particles present within the cell. In some embodiments, especially for non-nuclear uses, NLSs are not preferred. In some embodiments, a CRISPR system comprises one or more nuclear exports signals (NESs). In some embodiments, a CRISPR system comprises one or more NLSs and one or more NESs. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In general, a CRISPR system is characterized by elements that promote the formation of a CRISPR complex at the site of a target sequence. In the context of formation of a CRISPR complex, "target sequence" refers to a sequence to which a guide sequence is designed to have complementarity, where hybridization between a target DNA sequence and a guide sequence promotes the formation of a CRISPR complex.

The terms "guide molecule," "guide RNA," and 'guide" are used interchangeably herein to refer to nucleic acid-based molecules, including, but not limited to, RNA-based molecules that are capable of forming a complex with a CRISPR-Cas protein and comprise a guide sequence having sufficient complementarity with a target nucleic acid sequence to hybridize with the target nucleic acid sequence and direct sequence-specific binding of the complex to the target nucleic acid sequence. The guide molecule or guide RNA specifically encompasses RNA-based molecules having one or more chemical modifications (e.g., by chemically linking two ribonucleotides or by replacement of one or more ribonucleotides with one or more deoxyribonucleotides), as described herein.

In certain embodiments, the target sequence should be associated with a PAM (protospacer adjacent motif) or PFS (protospacer flanking sequence or site); that is, a short sequence recognized by the CRISPR complex. Depending on the nature of the CRISPR-Cas protein, the target sequence should be selected such that its complementary sequence in the DNA duplex (also referred to herein as the non-target sequence) is upstream or downstream of the PAM. In the embodiments of the present invention where the CRISPR-Cas protein is a C2c1 protein, the complementary sequence of the target sequence is downstream or 3' of the PAM. The precise sequence and length requirements for the PAM differ depending on the C2c1 protein used, but PAMs are typically 2-5 base pair sequences adjacent the protospacer (that is, the target sequence). Examples of the natural PAM sequences for different C2c1 orthologues are provided herein below and the skilled person will be able to identify further PAM sequences for use with a given C2c1 protein.

The systems may be used for the modification of the one or more target sequences (e.g., in a cell or cell population). The modification may result in altered expression of at least one gene product. In some examples, the expression of the at least one gene product may be increased. In some examples, the expression of the at least one gene product may be decreased.

In some examples, the modification may be made in a cell or population of cells, and the modification may result in the cell or population producing and/or secreting an endogenous or non-endogenous biological product or chemical compound. The chemical compound or biological product may include a low molecular weight compound, but may also be a larger compound, or any organic or inorganic molecule effective in the given situation, including modified and unmodified nucleic acids such as antisense nucleic acids, RNAi, such as siRNA or shRNA, CRISPR-Cas systems, peptides, peptidomimetics, receptors, ligands, antibodies, aptamers, polypeptides, nucleic acid analogues or variants thereof. Examples include an oligomer of nucleic acids, amino acids, or carbohydrates including, without limitation, proteins, oligonucleotides, ribozymes, DNAzymes, glycoproteins, siRNAs, lipoproteins, aptamers, and modifications and combinations thereof. Agents can be selected from a group comprising: chemicals; small molecules; nucleic acid sequences; nucleic acid analogues; proteins; peptides; aptamers; antibodies; or fragments thereof. A nucleic acid sequence can be RNA or DNA, and can be single or double stranded, and can be selected from a group comprising: nucleic acid encoding a protein of interest, oligonucleotides, nucleic acid analogues, for example peptide-nucleic acid (PNA), pseudo-complementary PNA (pc-PNA), locked nucleic acid (LNA), modified RNA (mod-RNA), single guide RNA, etc. Such nucleic acid sequences include, for example, but are not limited to, nucleic acid sequence encoding proteins, for example that act as transcriptional repressors, antisense molecules, ribozymes, small inhibitory nucleic acid sequences, for example, but are not limited to, RNAi, shRNAi, siRNA, micro RNAi (mRNAi), antisense oligonucleotides, CRISPR guide RNA, for example that target a CRISPR enzyme to a specific DNA target sequence, etc. A protein and/or peptide or fragment thereof can be any protein of interest, for example, but are not limited to: mutated proteins; therapeutic proteins and truncated proteins, wherein the protein is normally absent or expressed at lower levels in the cell. Proteins can also be selected from a group comprising: mutated proteins, genetically engineered proteins, peptides, synthetic peptides, recombinant proteins, chimeric proteins, antibodies, minibodies, humanized proteins, humanized antibodies, chimeric antibodies, modified proteins and fragments thereof. Alternatively, the agent can be intracellular within the cell as a result of introduction of a nucleic acid sequence into the cell and its transcription resulting in the production of the nucleic acid and/or protein modulator of a gene within the cell. In some embodiments, the agent is any chemical, entity or moiety, including without limitation synthetic and naturally-occurring non-proteinaceous entities. In certain embodiments, the agent is a small molecule having a chemical moiety. Agents can be known to have a desired activity and/or property, or can be selected from a library of diverse compounds.

Determination of PAM

Applicants introduce a plasmid containing both a PAM and a resistance gene into the heterologous *E. coli*, and then plate on the corresponding antibiotic. If there is DNA cleavage of the plasmid, Applicants observe no viable colonies. In further detail, the assay is as follows for a DNA target. Two *E. coli* strains are used in this assay. One carries a plasmid that encodes the endogenous effector protein locus from the bacterial strain. The other strain carries an empty plasmid (e.g., pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has an 8 random bp 5' of the proto-spacer (e.g., total of 65536 different PAM sequences=complexity). The other library has 7 random bp 3' of the proto-spacer (e.g., total complexity is 16384 different PAMs). Both libraries were cloned to have in average 500 plasmids per possible PAM. Test strain and control strain are transformed with 5'PAM and 3'PAM library in separate transformations and transformed cells are plated separately on ampicillin plates. Recognition and subsequent cutting/interference with the plasmid renders a cell vulnerable to ampicillin and prevents growth. Approximately 12 h after transformation, all colonies formed by the test and control strains were harvested and plasmid DNA was isolated. Plasmid DNA was used as a template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strains showed which PAMs are not recognized by the enzyme and comparison to the control strain allows extracting the sequence of the depleted PAM.

For the C2c1 orthologues identified to date, the following PAMs have been identified: the *Alicyclobacillus acidoterrestris* ATCC 49025 C2c1p (AacC2c1) can cleave target sites preceded by a 5' TTN PAM, where N is A, C, G, or T, more preferably where N is A, G, or T; *Bacillus thermoamylovorans* strain B4166 C2c1p (BthC2c1) can cleave sites preceded by ATTN, where N is A/C/G or T.

Codon Optimized Nucleic Acid Sequences

Where the effector protein is to be administered as a nucleic acid, the application envisages the use of codon-optimized CRISPR-Cas type V protein, and more particularly C2c1-encoding nucleic acid sequences (and optionally protein sequences). An example of a codon optimized sequence is, in this instance, a sequence optimized for expression in a eukaryote, e.g., humans (i.e., being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., C2c1) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a plant or a mammal, including, but not limited to, human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA). In some embodiments, one or more codons (e.g., 1, 2, 3, 4, 5, 10, 15, 20, 25, 50, or more, or all codons) in a sequence encoding a DNA/RNA-targeting Cas protein correspond to the most frequently used codon for a particular amino acid. As to codon usage in yeast, reference is made to the online Yeast Genome database available at yeastgenome.org/community/codon_usage.shtml, or Codon selection in yeast, Bennetzen and Hall, J Biol Chem. 1982 Mar. 25; 257(6):3026-31. As to codon usage in plants including algae, reference is made to Codon usage in higher plants, green algae, and cyanobacteria, Campbell and Gowri, Plant Physiol. 1990 January; 92(1): 1-11.; as well as Codon usage in plant genes, Murray et al, Nucleic Acids Res. 1989 Jan. 25; 17(2):477-98; or Selection on the codon bias of chloroplast and cyanelle genes in different plant and algal lineages, Morton B R, J Mol Evol. 1998 April; 46(4):449-59.

Guide Molecules

As used herein, the terms "crRNA" or "guide RNA" or "single guide RNA" or "sgRNA" or "one or more nucleic acid components" of a Type V or Type VI CRISPR-Cas locus effector protein comprise any polynucleotide sequence having sufficient complementarity with a target nucleic acid sequence to hybridize with the target nucleic acid sequence and direct sequence-specific binding of a nucleic acid-targeting complex to the target nucleic acid sequence, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting examples of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at .novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide, may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule. In the context of deaminase conjugates, the target nucleic acid sequence or target sequence is the sequence comprising the target adenosine to be deaminated, also referred to herein as the "target adenosine". In some embodiments, the complementarity described herein above excludes an intended mismatch, such as the dA-C mismatch described herein. The guide sequence may hybridize to a target DNA sequence in a prokaryotic cell. The guide sequence may hybridize to a target DNA sequence in a eukaryotic cell.

In some embodiments, a nucleic acid-targeting guide is selected to reduce the degree of the secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In some embodiments, the guide molecule comprises a guide sequence that is designed to have at least one mismatch with the target sequence, such that a heteroduplex formed between the guide sequence and the target sequence comprises a non-pairing C in the guide sequence opposite to the target A for deamination on the target sequence. In some embodiments, aside from this A-C mismatch, the degree of complementarity, when optimally aligned using a suitable alignment algorithm, is about or more than about 50%, 60%, 75%, 80%, 85%, 90%, 95%, 97.5%, 99%, or more.

In certain embodiments, the guide sequence or spacer length of the guide molecules is from 10 to 50 nt, more particularly from 15 to 35 nt in length. In certain embodiments, the spacer length of the guide RNA is at least 15 nucleotides. In certain embodiments, the spacer length is from 10 to 15 nt, e.g., 10, 11, 12, 13, 14, 15 from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer. In certain example embodiments, the guide sequence is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt.

In some embodiments of CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 98.5% or 98% or 97.5% or 97% or 96.5% or 96% or 95.5% or 95% or 94.5% complementarity between the sequence and the guide.

In particularly preferred embodiments according to the invention, the guide RNA (capable of guiding Cas to a target locus) may comprise (1) a guide sequence capable of hybridizing to a genomic target locus in the eukaryotic cell; (2) a tracr sequence; and (3) a tracr mate sequence. All (1) to (3) may reside in a single RNA, i.e., an sgRNA (arranged in a 5' to 3' orientation), or the tracr RNA may be a different RNA than the RNA containing the guide and tracr sequence. The tracr hybridizes to the tracr mate sequence and directs the CRISPR/Cas complex to the target sequence. Where the tracr RNA is on a different RNA than the RNA containing the guide and tracr sequence, the length of each RNA may be optimized to be shortened from their respective native lengths, and each may be independently chemically modified to protect from degradation by cellular RNase or otherwise increase stability.

The "tracrRNA" sequence or analogous terms includes any polynucleotide sequence that has sufficient complementarity with a crRNA sequence to hybridize. In some embodiments, the degree of complementarity between the tracrRNA sequence and crRNA sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and crRNA sequence are contained within a single transcript, such that hybridization between the two produces a transcript having a secondary structure, such as a hairpin. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In a hairpin structure, the portion of the sequence 5' of the final "N" and upstream of the loop corresponds to the tracr mate sequence, and the portion of the sequence 3' of the loop corresponds to the tracr sequence. In some embodiments, the systems comprise one or more crRNAs. For example, the systems may comprise two or more crRNAs.

In general, degree of complementarity is with reference to the optimal alignment of the guide sequence and tracr sequence, along the length of the shorter of the two sequences. Optimal alignment may be determined by any suitable alignment algorithm, and may further account for secondary structures, such as self-complementarity within either the crRNAsequence or tracr sequence. In some embodiments, the degree of complementarity between the tracr sequence and crRNA sequence along the length of the shorter of the two when optimally aligned is about or more than about 25%, 30%, 40%, 50%, 60%, 70%, 80%, 90%, 95%, 97.5%, 99%, or higher.

In one aspect of the invention, the guide comprises a modified crRNA for C2c1, having a 5'-handle and a guide segment further comprising a seed region and a 3'-terminus. In some embodiments, the modified guide can be used with a C2c1 of any one of the orthologues listed in Tables 1 and 2.

Modified Guides

In certain embodiments, guides of the invention comprise non-naturally occurring nucleic acids, and/or non-naturally occurring nucleotides, and/or nucleotide analogs, and/or chemically modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotides or nucleotide analogs such as a nucleotide with phosphorothioate linkage, boranophosphate linkage, a locked nucleic acid (LNA), nucleotides comprising a methylene bridge between the 2' and 4' carbons of the ribose ring, peptide nucleic acids (PNA), or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified nucleotides include linkage of chemical moieties at the 2' position, including, but not limited to, peptides, nuclear localization sequence (NLS), peptide nucleic acid (PNA), polyethylene glycol (PEG), triethylene glycol, or tetraethyleneglycol (TEG). Further examples of modified bases include, but are not limited to, 2-aminopurine, 5-bromo-uridine, pseudouridine (Ψ), N1-methylpseudouridine (me1Ψ), 5-methoxyuridine (5moU), inosine, 7-methylguanosine. Examples of guide RNA chemical modifications include, without limitation, incorporation of 2'-O-methyl (M), 2'-O-methyl-3'-phosphorothioate (MS), phosphorothioate (PS), S-constrained ethyl (cEt), 2'-O-methyl-3'-thioPACE (MSP), or 2'-O-methyl-3'-phosphonoacetate (MP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015; Ragdarm et al., 0215, PNAS, E7110-E7111; Allerson et al., J. Med. Chem. 2005, 48:901-904; Bramsen et al., Front. Genet., 2012, 3:154; Deng et al., PNAS, 2015, 112:11870-11875; Sharma et al., MedChemComm., 2014, 5:1454-1471; Hendel et al., Nat. Biotechnol. (2015) 33(9): 985-989; Li et al., Nature Biomedical Engineering, 2017, 1, 0066 DOI:10.1038/s41551-017-0066; Ryan et al., Nucleic Acids Res. (2018) 46(2): 792-803).

In some embodiments, the modification to the guide is a chemical modification, an insertion, a deletion, or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromo-uridine, pseudouridine (Ψ), N1-methylpseudouridine (me1Ψ), 5-methoxyuridine (5moU), inosine, 7-methylguanosine, 2'-O-methyl-3'-phosphorothioate (MS), S-constrained ethyl(cEt), phosphorothioate (PS), 2'-O-methyl-3'-thioPACE (MSP), or 2'-O-methyl-3'-phosphonoacetate (MP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In some embodiments, all nucleotides are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle are chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., Nature Biomedical Engineering, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs. In some embodiments, 3 nucleotides at each of the 3' and 5' ends are chemically modified. In a specific embodiment, the modifications comprise 2'-O-methyl or phosphorothioate analogs. In a specific embodiment, 12 nucleotides in the tetraloop and 16 nucleotides in the stem-loop region are replaced with 2'-O-methyl analogs. Such chemical modifications improve in vivo editing and stability (see Finn et al., Cell Reports (2018), 22: 2227-2235).

In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233: 74-83). In certain embodiments, a guide comprises ribonucleotides in a region that binds to a target DNA and one or more deoxyribonucletides and/or nucleotide analogs in a region that binds to Cas9, Cpf1, or C2c1. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide are chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), 2'-O-methyl-3'-thioPACE (MSP), or 2'-O-methyl-3'-phosphonoacetate (MP). Such modification can enhance genome editing efficiency (see Hendel et al., Nat. Biotechnol. (2015) 33(9): 985-989; Ryan et al., Nucleic Acids Res. (2018) 46(2): 792-803). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guides can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to, amine, azide, alkyne, thio, dibenzocyclooctyne (DBCO), Rhodamine, peptides, nuclear localization sequence (NLS), peptide nucleic acid (PNA), polyethylene glycol (PEG), triethylene glycol, or tetraethyleneglycol (TEG). In certain embodiments, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guides can be used to identify or enrich cells generically edited by a CRISPR system (see Lee et al., eLife, 2017, 6:e25312, DOI:10.7554). In some embodiments, 3 nucleotides at each of the 3' and 5' ends are chemically modified. In a specific embodiment, the modifications comprise 2'-O-methyl or phosphorothioate analogs. In a specific embodiment, 12 nucleotides in the tetraloop and 16 nucleotides in the stem-loop region are replaced with 2'-O-methyl analogs. Such chemical modifications improve in vivo editing and stability (see Finn et al., Cell Reports (2018), 22: 2227-2235). In some embodiments, more than 60 or 70 nucleotides of the guide are chemically modified. In some embodiments, this modification comprises replacement of nucleotides with 2'-O-methyl or 2'-fluoro nucleotide analogs or phosphorothioate (PS) modification of phosphodiester bonds. In some embodiments, the chemical modification comprises 2'-O-methyl or 2'-fluoro modification of guide nucleotides extending outside of the nuclease protein when the CRISPR complex is formed or PS modification of 20 to 30 or more nucleotides of the 3'-terminus of the guide. In a particular embodiment, the chemical modification further comprises 2'-O-methyl analogs at the 5' end of the guide or 2'-fluoro analogs in the seed and tail regions. Such chemical modifications improve stability to nuclease degradation and maintain or enhance genome-editing activity or efficiency, but modification of all nucleotides may abolish the function of the guide (see Yin et al., Nat. Biotech. (2018), 35(12): 1179-1187). Such chemical modifications may be guided by knowledge of the structure of the CRISPR complex, including knowledge of the limited number of nuclease and RNA 2'-OH interactions (see Yin et al., Nat. Biotech. (2018), 35(12): 1179-1187). In some embodiments, one or more guide RNA nucleotides may be replaced with DNA nucleotides. In some embodiments, up to 2, 4, 6, 8, 10, or 12 RNA nucleotides of the 5'-end tail/seed guide region are replaced with DNA nucleotides. In certain embodiments, the majority of guide RNA nucleotides at the 3' end are replaced with DNA nucleotides. In particular embodiments, 16 guide RNA nucleotides at the 3' end are replaced with DNA nucleotides. In particular embodiments, 8 guide RNA nucleotides of the 5'-end tail/seed region and 16 RNA nucleotides at the 3' end are replaced with DNA nucleotides. In particular embodiments, guide RNA nucleotides that extend outside of the nuclease protein when the CRISPR complex is formed are replaced with DNA nucleotides. Such replacement of multiple RNA nucleotides with DNA nucleotides leads to decreased off-target activity but similar on-target activity compared to an unmodified guide; however, replacement of all RNA nucleotides at the 3' end may abolish the function of the guide (see Yin et al., Nat. Chem. Biol. (2018) 14, 311-316). Such modifications may be guided by knowledge of the structure of the CRISPR complex, including knowledge of the limited number of nuclease and RNA 2'-OH interactions (see Yin et al., Nat. Chem. Biol. (2018) 14, 311-316).

A guide sequence, and hence a nucleic acid-targeting guide RNA, may be selected to target any target nucleic acid sequence. The target sequence may be DNA. The target sequence may be genomic DNA. The target sequence may be mitochondrial DNA. The guide molecule or guide RNA of a Class 2 type V CRISPR-Cas protein comprises a tracr-mate sequence (encompassing a "direct repeat" in the context of an endogenous CRISPR system) and a guide sequence (also referred to as a "spacer" in the context of an endogenous CRISPR system). Native Cas12b CRISPR-Cas systems employ tracr sequences.

In certain embodiments, the guide molecule (capable of guiding C2c1 to a target locus) comprises (1) a guide sequence capable of hybridizing to a target locus and (2) a tracr mate or direct repeat sequence whereby the direct repeat sequence is located upstream (i.e., 5') from the guide sequence. In a particular embodiment, the seed sequence (i.e., the sequence essential for recognition and/or hybridization to the sequence at the target locus) of the C2c1 guide sequence is approximately within the first 10 nucleotides of the guide sequence. In particular embodiments, the seed sequence is approximately within the first 5 nt on the 5' end of the guide sequence.

In some embodiments, the loop of the 5'-handle of the guide is modified. In some embodiments, the loop of the 5'-handle of the guide is modified to have a deletion, an insertion, a split, or chemical modifications. In certain embodiments, the modified loop comprises 3, 4, or 5 nucleotides. In certain embodiments, the loop comprises the sequence of UCUU, UUUU, UAUU, or UGUU. In some embodiments, the guide molecule forms a stem loop with a separate non-covalently linked sequence, which can be DNA or RNA.

Stem Loops & Hairpins

In relation to a nucleic acid-targeting complex or system preferably, the crRNA sequence and the chimeric guide sequence can comprise one or more stem loops or hairpins. The use of an aptamer-modified guide allows for binding of adaptor-containing protein to the guide. The adaptor may be fused to any functional domain, thus providing for attachment of the functional domain to the guide. The use of two different aptamers allows separate targeting by two guides. A large number of such modified nucleic acid-targeting guide RNAs can be used all at the same time, for example 10 or 20 or 30 and so forth, while only one (or at least a minimal number) of effector protein molecules need to be delivered, as a comparatively small number of protein molecules can be used with a large number of modified guides. The fusion between the adaptor protein and a functional domain such as an activator or repressor may include a linker. For example, GlySer linkers GGGS (SEQ ID NO: 402) can be used. They can be used in repeats of 3 $(GGGGS)_3$ (SEQ ID NO: 393) or 6 (SEQ ID NO: 394), 9 (SEQ ID NO: 395), or even 12 (SEQ ID NO: 396) or more, to provide suitable lengths, as required. Linkers can be used between the guide RNAs and the functional domain (activator or repressor), or between the nucleic acid-targeting Cas protein (Cas) and the functional domain (activator or repressor). The linkers allow the user to engineer appropriate amounts of "mechanical flexibility".

In particular embodiments, the stem comprises at least about 4 bp comprising complementary X and Y sequences, although stems of more, e.g., 5, 6, 7, 8, 9, 10, 11 or 12 or fewer, e.g., 3, 2, base pairs are also contemplated. Thus, for example, X2-10 and Y2-10 (wherein X and Y represent any complementary set of nucleotides) may be contemplated. In one aspect, the stem made of the X and Y nucleotides together with the loop will form a complete hairpin in the overall secondary structure, and this may be advantageous and the amount of base pairs can be any amount that forms a complete hairpin. In one aspect, any complementary X:Y base-pairing sequence (e.g., as to length) is tolerated, so long as the secondary structure of the entire guide molecule is preserved. In one aspect, the loop that connects the stem made of X:Y base pairs can be any sequence of the same length (e.g., 4 or 5 nucleotides) or longer that does not interrupt the overall secondary structure of the guide molecule. In one aspect, the stem loop can further comprise, e.g., an MS2 aptamer. In one aspect, the stem comprises about 5-7 bp comprising complementary X and Y sequences, although stems of more or fewer base pairs are also contemplated. In one aspect, non-Watson Crick base pairing is contemplated, where such pairing otherwise generally preserves the architecture of the stem-loop at that position.

In particular embodiments, a natural hairpin or stem-loop structure of the guide molecule is extended or replaced by an extended stem-loop. It has been demonstrated in certain cases that extension of the stem can enhance the assembly of the guide molecule with the CRISPR-Cas protein (Chen et al. Cell. (2013); 155(7): 1479-1491). In particular embodiments, the stem of the stem loop is extended by at least 1, 2, 3, 4, 5 or more complementary base pairs (i.e., corresponding to the addition of 2, 4, 6, 8, 10 or more nucleotides in the guide molecule). In particular embodiments, these are located at the end of the stem, adjacent to the loop of the stem loop.

In some embodiments, the guide molecule forms a stem loop with a separate non-covalently linked sequence, which can be DNA or RNA. In particular embodiments, the sequences forming the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, these sequences can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sufonyl, ally, propargyl, diene, alkyne, and azide. Once this sequence is functionalized, a covalent chemical bond or linkage can be formed between this sequence and the direct repeat sequence. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, these stem-loop forming sequences can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

Reduced RNase Susceptibility

In some embodiments, it is of interest to reduce the susceptibility of the guide molecule to RNA cleavage, such as to cleavage by Cas12b. Accordingly, in particular embodiments, the guide molecule is adjusted to avoid cleavage by Cas12b or other RNA-cleaving enzymes.

In particular embodiments, the susceptibility of the guide molecule to RNases or to decreased expression can be reduced by slight modifications of the sequence of the guide molecule, which do not affect its function. For instance, in particular embodiments, premature termination of transcription, such as premature transcription of U6 Pol-III, can be removed by modifying a putative Pol-III terminator (4 consecutive U's) in the guide molecule's sequence. Where such sequence modification is required in the stem loop of the guide molecule, it is preferably ensured by a base pair flip.

Reduced Secondary Structure

In some embodiments, the sequence of the guide molecule (direct repeat and/or spacer) is selected to reduce the degree secondary structure within the guide molecule. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

Conjugated Tracr Sequences

In some embodiments, the guide molecule comprises a tracr sequence and a tracr mate sequence that are chemically linked or conjugated via a non-phosphodiester bond. In one aspect, the guide comprises a tracr sequence and a tracr mate sequence that are chemically linked or conjugated via a non-nucleotide loop. In some embodiments, the tracr and tracr mate sequences are joined via a non-phosphodiester covalent linker. Examples of the covalent linker include, but are not limited to, a chemical moiety selected from the group consisting of carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, the tracr and tracr mate sequences are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, the tracr or tracr mate sequences can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sufonyl, ally, propargyl, diene, alkyne, and azide. Once the tracr and the tracr mate sequences are functionalized, a covalent chemical bond or linkage can be formed between the two oligonucleotides. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, the tracr and tracr mate sequences can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

In some embodiments, the tracr and tracr mate sequences can be covalently linked using various bioconjugation reactions, loops, bridges, and non-nucleotide links via modifications of sugar, internucleotide phosphodiester bonds, purine and pyrimidine residues. Sletten et al., Angew. Chem. Int. Ed. (2009) 48:6974-6998; Manoharan, M. Curr. Opin. Chem. Biol. (2004) 8: 570-9; Behlke et al., Oligonucleotides (2008) 18: 305-19; Watts, et al., Drug. Discov. Today (2008) 13: 842-55; Shukla, et al., ChemMedChem (2010) 5: 328-49.

In some embodiments, the tracr and tracr mate sequences can be covalently linked using click chemistry. In some embodiments, the tracr and tracr mate sequences can be covalently linked using a triazole linker. In some embodiments, the tracr and tracr mate sequences can be covalently linked using Huisgen 1,3-dipolar cycloaddition reaction involving an alkyne and azide to yield a highly stable triazole linker (He et al., ChemBioChem (2015) 17: 1809-1812; WO 2016/186745). In some embodiments, the tracr and tracr mate sequences are covalently linked by ligating a 5'-hexyne tracrRNA and a 3'-azide crRNA. In some embodiments, either or both of the 5'-hexyne tracrRNA and a 3'-azide crRNA can be protected with 2'-acetoxyethl orthoester (2'-ACE) group, which can be subsequently removed using Dharmacon protocol (Scaringe et al., J. Am. Chem. Soc. (1998) 120: 11820-11821; Scaringe, Methods Enzymol. (2000) 317: 3-18).

In some embodiments, the tracr and tracr mate sequences can be covalently linked via a linker (e.g., a non-nucleotide loop) that comprises a moiety such as spacers, attachments, bioconjugates, chromophores, reporter groups, dye labeled RNAs, and non-naturally occurring nucleotide analogues. More specifically, suitable spacers for purposes of this invention include, but are not limited to, polyethers (e.g., polyethylene glycols, polyalcohols, polypropylene glycol or mixtures of ethylene and propylene glycols), polyamines group (e.g., spennine, spermidine and polymeric derivatives thereof), polyesters (e.g., poly(ethyl acrylate)), polyphosphodiesters, alkylenes, and combinations thereof. Suitable attachments include any moiety that can be added to the linker to add additional properties to the linker, such as but not limited to, fluorescent labels. Suitable bioconjugates include, but are not limited to, peptides, glycosides, lipids, cholesterol, phospholipids, diacyl glycerols and dialkyl glycerols, fatty acids, hydrocarbons, enzyme substrates, steroids, biotin, digoxigenin, carbohydrates, polysaccharides. Suitable chromophores, reporter groups, and dye-labeled RNAs include, but are not limited to, fluorescent dyes such as fluorescein and rhodamine, chemiluminescent, electrochemiluminescent, and bioluminescent marker compounds. The design of example linkers conjugating two RNA components are also described in WO 2004/015075.

The linker (e.g., a non-nucleotide loop) can be of any length. In some embodiments, the linker has a length equivalent to about 0-16 nucleotides. In some embodiments, the linker has a length equivalent to about 0-8 nucleotides. In some embodiments, the linker has a length equivalent to about 0-4 nucleotides. In some embodiments, the linker has a length equivalent to about 2 nucleotides. Example linker design is also described in WO2011/008730.

A typical Cas9 sgRNA comprises (in 5' to 3' direction): a guide sequence, a poly U tract, a first complimentary stretch (the "repeat"), a loop (tetraloop), a second complimentary stretch (the "anti-repeat" being complimentary to the repeat), a stem, and further stem loops and stems and a poly A (often poly U in RNA) tail (terminator). A typical Cas12b sgRNA comprises similar components, but in the opposite orientation, i.e., the 3' to 5' direction. A direct repeat (DR) hybridizes with tracrRNA to form a crRNA:tracrRNA duplex, which is then loaded onto Cas12b to guide DNA recognition and cleavage. Cas12b recognizes the T-rich PAM at the 5' end of the protospacer sequence to mediate DNA interference. In certain embodiments, the 5' end of the tracr forms a stem-loop. In certain embodiments, nucleotides of the tracrRNA and the 5' DR form a repeat:anti-repeat duplex. In certain embodiments, the sgRNA architecture accords with the structure predicted by Shmakov et al., 2015, Molecular Cell 60, 385-397. In certain embodiments, the sgRNA architecture accords with the structure predicted by Liu et al., 2017, Molecular Cell 65, 310-322. In preferred embodiments, certain aspects of guide architecture are retained, certain aspect of guide architecture cam be modified, for example by addition, subtraction, or substitution of features, whereas certain other aspects of guide architecture are maintained. Preferred locations for engineered sgRNA modifications including, but not limited to, insertions, deletions, and substitutions include guide termini and regions of the sgRNA that are exposed when complexed with CRISPR protein and/or target, for example the tetraloop and/or loop2.

In certain embodiments, guides of the invention comprise specific binding sites (e.g., aptamers) for adapter proteins, which may comprise one or more functional domains (e.g., via fusion protein). When such a guide forms a CRISPR complex (i.e., CRISPR enzyme binding to guide and target), the adapter proteins bind and, the functional domain associated with the adapter protein is positioned in a spatial orientation which is advantageous for the attributed function to be effective. For example, if the functional domain is a transcription activator (e.g., VP64 or p65), the transcription activator is placed in a spatial orientation, which allows it to affect the transcription of the target. Likewise, a transcription repressor will be advantageously positioned to affect the transcription of the target and a nuclease (e.g., Fok1) will be advantageously positioned to cleave or partially cleave the target.

The skilled person will understand that modifications to the guide which allow for binding of the adapter+functional domain but not proper positioning of the adapter+functional domain (e.g., due to steric hindrance within the three-dimensional structure of the CRISPR complex) are modifications which are not intended. The one or more modified guides may be modified at the tetra loop, the stem loop 1, stem loop 2, or stem loop 3, as described herein, preferably at either the tetra loop or stem loop 2, and most preferably at both the tetra loop and stem loop 2.

The repeat:anti repeat duplex will be apparent from the secondary structure of the sgRNA. In a typical Cas9 sgRNA, it may be typically a first complimentary stretch after (in 5' to 3' direction) the poly U tract and before the tetraloop; and a second complimentary stretch after (in 5' to 3' direction) the tetraloop and before the poly A tract. The first complimentary stretch (the "repeat") is complimentary to the second complimentary stretch (the "anti-repeat"). In certain embodiments, the architecture of a Cas12b sgRNA accords with the structure predicted by Shmakov et al., 2015, Molecular Cell 60, 385-397. In certain embodiments, the architecture of a Cas12b sgRNA architecture accords with the structure predicted by Liu et al., 2017, Molecular Cell 65, 310-322. As such, the sgRNAs comprise Watson-Crick base pairs to form a duplex of dsRNA when folded back on one another. As such, the anti-repeat sequence is the complimentary sequence of the repeat and in terms to A-U or C-G base pairing, but also in terms of the fact that the anti-repeat is in the reverse orientation due to stem-loops or other architectural features.

In an embodiment of the invention, modification of guide architecture comprises replacing bases in stem loop 2. For example, in some embodiments, "actt" ("acuu" in RNA) and "aagt" ("aagu" in RNA) bases in stem loop 2 are replaced with "cgcc" and "gcgg". In some embodiments, "actt" and "aagt" bases in stem loop 2 are replaced with complimentary GC-rich regions of 4 nucleotides. In some embodiments, the complimentary GC-rich regions of 4 nucleotides are "cgcc" and "gcgg" (both in 5' to 3' direction). In some embodiments, the complimentary GC-rich regions of 4 nucleotides are "gcgg" and "cgcc" (both in 5' to 3' direction). Other combination of C and G in the complimentary GC-rich regions of 4 nucleotides will be apparent including CCCC and GGGG.

In one aspect, the stem loop 2, e.g., "ACTTgtttAAGT" (SEQ ID NO: 397) can be replaced by any "XXXXgtttYYYY" (SEQ ID NO: 398), e.g., where XXXX and YYYY represent any complementary sets of nucleotides that together will base pair to each other to create a stem.

In one aspect, the stem comprises at least about 4 bp comprising complementary X and Y sequences, although stems of more, e.g., 5, 6, 7, 8, 9, 10, 11 or 12 or fewer, e.g., 3, 2, base pairs are also contemplated. Thus, for example X2-12 and Y2-12 (wherein X and Y represent any complementary set of nucleotides) may be contemplated. In one aspect, the stem made of the X and Y nucleotides, together with the "gttt," will form a complete hairpin in the overall secondary structure; this may be advantageous and the amount of base pairs can be any amount that forms a complete hairpin. In one aspect, any complementary X:Y base pairing sequence (e.g., as to length) is tolerated, so long as the secondary structure of the entire sgRNA is preserved. In one aspect, the stem can be a form of X:Y base pairing that does not disrupt the secondary structure of the whole sgRNA in that it has a DR:tracr duplex, and 3 stem loops. In one aspect, the "gttt" tetraloop that connects ACTT and AAGT (or any alternative stem made of X:Y base pairs) can be any sequence of the same length (e.g., 4 base pairs) or longer that does not interrupt the overall secondary structure of the sgRNA. In one aspect, the stem loop can be something that further lengthens stem loop 2, e.g., can be MS2 aptamer. In one aspect, the stem loop 3 "GGCACCGagtCGGTGC" (SEQ ID NO: 399) can likewise take on a "XXXXXXXagtYYYYYYY" (SEQ ID NO: 400) form, e.g., wherein X7 and Y7 represent any complementary sets of nucleotides that together will base pair to each other to create a stem. In one aspect, the stem comprises about 7 bp comprising complementary X and Y sequences, although stems of more or fewer base pairs are also contemplated. In one aspect, the stem made of the X and Y nucleotides, together with the "agt", will form a complete hairpin in the overall secondary structure. In one aspect, any complementary X:Y base pairing sequence is tolerated, so long as the secondary structure of the entire sgRNA is preserved. In one aspect, the stem can be a form of X:Y base pairing that doesn't disrupt the secondary structure of the whole sgRNA in that it has a DR:tracr duplex, and 3 stem loops. In one aspect, the "agt" sequence of the stem loop 3 can be extended or be replaced by an aptamer, e.g., a MS2 aptamer or sequence that otherwise generally preserves the architecture of stem loop 3. In one aspect for alternative stem loops 2 and/or 3, each X and Y pair can refer to any base pair. In one aspect, non-Watson Crick base pairing is contemplated, where such pairing otherwise generally preserves the architecture of the stem loop at that position.

In one aspect, the DR:tracrRNA duplex can be replaced with the form: gYYYYag(N)NNNNxxxxNNNN(AAN)uuRRRRu (SEQ ID NO: 401) (using standard IUPAC nomenclature for nucleotides), wherein (N) and (AAN) represent part of the bulge in the duplex, and "xxxx" represents a linker sequence. NNNN on the direct repeat can be anything so long as it base pairs with the corresponding NNNN portion of the tracrRNA. In one aspect, the DR:tracrRNA duplex can be connected by a linker of any length (xxxx . . . ), any base composition, as long as it does not alter the overall structure.

In one aspect, the sgRNA structural requirement is to have a duplex and 3 stem loops. In most aspects, the actual sequence requirement for many of the particular base requirements are lax, in that the architecture of the DR:tracrRNA duplex should be preserved, but the sequence that creates the architecture, i.e., the stems, loops, bulges, etc., may be altered.

One guide with a first aptamer/RNA-binding protein pair can be linked or fused to an activator, whilst a second guide with a second aptamer/RNA-binding protein pair can be linked or fused to a repressor. The guides are for different targets (loci), so this allows one gene to be activated and one repressed. For example, the following schematic shows such an approach:

Guide 1—MS2 aptamer-------MS2 RNA-binding protein------VP64 activator; and

Guide 2—PP7 aptamer-------PP7 RNA-binding protein-------SID4x repressor.

The present invention also relates to orthogonal PP7/MS2 gene targeting. In this example, sgRNA targeting different loci are modified with distinct RNA loops in order to recruit MS2-VP64 or PP7-SID4X, which activate and repress their target loci, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-VP64 activators, while another sgRNA targeting locus B can be modified with PP7 loops, recruiting PP7-SID4X repressor domains. In the same cell, dC2c1 can thus mediate orthogonal, locus-specific modifications. This principle can be extended to incorporate other orthogonal RNA-binding proteins such as Q-beta.

An alternative option for orthogonal repression includes incorporating non-coding RNA loops with transactive repressive function into the guide (either at similar positions to the MS2/PP7 loops integrated into the guide or at the 3' terminus of the guide). For instance, guides were designed with non-coding (but known to be repressive) RNA loops (e.g., using the Alu repressor (in RNA) that interferes with RNA polymerase II in mammalian cells). The Alu RNA sequence was located in place of the MS2 RNA sequences as used herein (e.g., at tetraloop and/or stem loop 2); and/or at 3' terminus of the guide. This gives possible combinations of MS2, PP7 or Alu at the tetraloop and/or stem loop 2 positions, as well as, optionally, addition of Alu at the 3' end of the guide (with or without a linker).

The use of two different aptamers (distinct RNA) allows an activator-adaptor protein fusion and a repressor-adaptor protein fusion to be used, with different guides, to activate expression of one gene, whilst repressing another. They, along with their different guides, can be administered together, or substantially together, in a multiplexed approach. A large number of such modified guides can be used all at the same time, for example 10 or 20 or 30 and so forth, whilst only one (or at least a minimal number) of C2c1s to be delivered, as a comparatively small number of C2c1s can be used with a large number of modified guides. The adaptor protein may be associated (preferably linked or fused to) with one or more activators or one or more repressors. For example, the adaptor protein may be associated with a first activator and a second activator. The first and second activators may be the same, but they are preferably different activators. For example, one might be VP64, whilst the other might be p65, although these are just examples and other transcriptional activators are envisaged. Three or more or even four or more activators (or repressors) may be used, but package size may limit the number being higher than 5 different functional domains. Linkers are preferably used, over a direct fusion, to the adaptor protein, where two or more functional domains are associated with the adaptor protein. Suitable linkers might include the GlySer linker.

It is also envisaged that the enzyme-guide complex as a whole may be associated with two or more functional domains. For example, there may be two or more functional domains associated with the enzyme, or there may be two or more functional domains associated with the guide (via one or more adaptor proteins), or there may be one or more functional domains associated with the enzyme and one or more functional domains associated with the guide (via one or more adaptor proteins).

The fusion between the adaptor protein and the activator or repressor may include a linker. For example, GlySer linkers GGGS (SEQ ID NO: 402) can be used. They can be used in repeats of 3 ($(GGGGS)_3$ (SEQ ID NO: 393)) or 6 (SEQ ID NO: 394), 9 (SEQ ID NO: 395) or even 12 (SEQ ID NO: 396) or more, to provide suitable lengths, as required. Linkers can be used between the RNA-binding protein and the functional domain (activator or repressor), or between the CRISPR Enzyme (C2c1) and the functional domain (activator or repressor). The linkers the user to engineer appropriate amounts of "mechanical flexibility".

Escorted & Inducible Guides

In a preferred embodiment, the direct repeat may be modified to comprise one or more protein-binding RNA aptamers. In a particular embodiment, one or more aptamers may be included such as part of optimized secondary structure. Such aptamers may be capable of binding a bacteriophage coat protein as detailed further herein.

In particular embodiment, the guide is an escorted guide. By "escorted" it is meant that the Cas12b CRISPR-Cas system or complex or guide is delivered to a selected time or place within a cell, so that activity of the Cas12b CRISPR-Cas system or complex or guide is spatially or temporally controlled. For example, the activity and destination of the Cas12b CRISPR-Cas system or complex or guide may be controlled by an escort RNA aptamer sequence that has binding affinity for an aptamer ligand, such as a cell surface protein or other localized cellular component. Alternatively, the escort aptamer may, for example, be responsive to an aptamer effector on or in the cell, such as a transient effector, such as an external energy source that is applied to the cell at a particular time.

The escorted Cas12b CRISPR-Cas systems or complexes have a guide molecule with a functional structure designed to improve guide molecule structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green fluorescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, in particular embodiments, the guide molecule is modified, e.g., by one or more aptamer(s) designed to improve guide molecule delivery, including delivery across the cellular membrane, to intracellular compartments, or into the nucleus. Such a structure can include, either in addition to the one or more aptamer(s) or without such one or more aptamer(s), moiety(ies) so as to render the guide molecule deliverable, inducible or responsive to a selected effector. The invention accordingly comprehends a guide molecule that responds to normal or pathological physiological conditions, including without limitation pH, hypoxia, $O_2$ concentration, temperature, protein concentration, enzymatic concentration, lipid structure, light exposure, mechanical disruption (e.g., ultrasound waves), magnetic fields, electric fields, or electromagnetic radiation.

Light responsiveness of an inducible system may be achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Crytochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 $mW/cm^2$. In a preferred embodiment, a stimulation paradigm of as low as 0.25 sec every 15 sec should result in maximal activation.

The chemical or energy sensitive guide may undergo a conformational change upon induction by the binding of a chemical source or by the energy allowing it act as a guide and have the C2c1 CRISPR-Cas system or complex function. The invention can involve applying the chemical source or energy so as to have the guide function and the C2c1 CRISPR-Cas system or complex function, and optionally further determining that the expression of the genomic locus is altered.

There are several different designs of this chemical inducible system: 1. ABI-PYL based system inducible by Abscisic Acid (ABA) (see, e.g., stke.sciencemag.org/cgi/content/abstract/sigtrans;4/164/rs2), 2. FKBP-FRB based system inducible by rapamycin (or related chemicals based on rapamycin) (see, e.g., nature.com/nmeth/journal/v2/n6/full/nmeth763.html), 3. GID1-GAI based system inducible by Gibberellin (GA) (see, e.g., nature.com/nchembio/journal/v8/n5/full/nchembio.922.html).

A chemical inducible system can be an estrogen receptor (ER) based system inducible by 4-hydroxytamoxifen (4OHT) (see, e.g., pnas.org/content/104/3/1027.abstract). A mutated ligand-binding domain of the estrogen receptor called ERT2 translocates into the nucleus of cells upon binding of 4-hydroxytamoxifen. In further embodiments of the invention, any naturally occurring or engineered derivative of any nuclear receptor, thyroid hormone receptor, retinoic acid receptor, estrogen receptor, estrogen-related receptor, glucocorticoid receptor, progesterone receptor, or androgen receptor may be used in inducible systems analogous to the ER based inducible system.

Another inducible system is based on the design using Transient receptor potential (TRP) ion channel based system inducible by energy, heat or radio-wave (see, e.g., sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the C2c1 CRISPR-Cas complex or system, and the binding will induce the change of sub-cellular localization of the polypeptide, leading to the entire polypeptide entering the nucleus of cells. Once inside the nucleus, the guide protein and the other components of the C2c1 CRISPR-Cas complex will be active and modulating target gene expression in cells.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 kVolts/cm under in vivo conditions. Instead of or in addition to the pulses, the electric field may be delivered in a continuous manner. The electric pulse may be applied for between 1 μs and 500 milliseconds, preferably between 1 μs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 kVolts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include the presence of an electric potential difference in the environment of a cell. Such an environment may be set up by way of static electricity, alternating current (AC), direct current (DC), etc., as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326).

The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100 microseconds duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between 1V/cm and 20V/cm, for a period of 100 milliseconds or more, preferably 15 minutes or more.

Ultrasound is advantageously administered at a power level of from about 0.05 W/cm$^2$ to about 100 W/cm$^2$. Diagnostic or therapeutic ultrasound may be used, or combinations thereof.

As used herein, the term "ultrasound" refers to a form of energy which consists of mechanical vibrations the frequencies of which are so high they are above the range of human hearing. Lower frequency limit of the ultrasonic spectrum may generally be taken as about 20 kHz. Most diagnostic applications of ultrasound employ frequencies in the range 1 and 15 MHz (From Ultrasonics in Clinical Diagnosis, P. N. T. Wells, ed., 2nd. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm$^2$ (FDA recommendation), although energy densities of up to 750 mW/cm$^2$ have been used. In physiotherapy, ultrasound is typically used as an energy source in a range up to about 3 to 4 W/cm$^2$ (WHO recommendation). In other therapeutic applications, higher intensities of ultrasound may be employed, for example, HIFU at 100 W/cm up to 1 kW/cm$^2$ (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142). Another form of focused ultrasound is high intensity focused ultrasound (HIFU) which is reviewed by Moussatov et al in Ultrasonics (1998) Vol. 36, No. 8, pp. 893-900 and TranHuuHue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm$^{-2}$. Even more preferably, the exposure to an ultrasound energy source is at a power density of from about 1 to about 15 Wcm$^{-2}$.

Preferably the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes.

Advantageously, the target tissue is exposed to an ultrasound energy source at an acoustic power density of from about 0.05 Wcm$^{-2}$ to about 10 Wcm$^{-2}$ with a frequency ranging from about 0.015 to about 10 MHz (see WO 98/52609). However, alternatives are also possible, for example, exposure to an ultrasound energy source at an acoustic power density of above 100 Wcm$^{-2}$, but for reduced periods of time, for example, 1000 Wcm$^{-2}$ for periods in the millisecond range or less.

Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 $Wcm^{-2}$ or 1.25 $Wcm^{-2}$ as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as, but not limited to, a lobe of the liver) or whole organ (such as, but not limited to, the entire liver or an entire muscle, such as the heart) therapy. Another important advantage is that ultrasound is a non-invasive stimulus, which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

The rapid transcriptional response and endogenous targeting of the instant invention make for an ideal system for the study of transcriptional dynamics. For example, the instant invention may be used to study the dynamics of variant production upon induced expression of a target gene. On the other end of the transcription cycle, mRNA degradation studies are often performed in response to a strong extracellular stimulus, causing expression level changes in a plethora of genes. The instant invention may be utilized to reversibly induce transcription of an endogenous target, after which point stimulation may be stopped and the degradation kinetics of the unique target may be tracked.

The temporal precision of the instant invention may provide the power to time genetic regulation in concert with experimental interventions. For example, targets with suspected involvement in long-term potentiation (LTP) may be modulated in organotypic or dissociated neuronal cultures, but only during stimulus to induce LTP, so as to avoid interfering with the normal development of the cells. Similarly, in cellular models exhibiting disease phenotypes, targets suspected to be involved in the effectiveness of a particular therapy may be modulated only during treatment. Conversely, genetic targets may be modulated only during a pathological stimulus. Any number of experiments in which timing of genetic cues to external experimental stimuli is of relevance may potentially benefit from the utility of the instant invention.

The in vivo context offers equally rich opportunities for the instant invention to control gene expression. Photo inducibility provides the potential for spatial precision. Taking advantage of the development of optrode technology, a stimulating fiber optic lead may be placed in a precise brain region. Stimulation region size may then be tuned by light intensity. This may be done in conjunction with the delivery of the C2c1 CRISPR-Cas system or complex of the invention, or, in the case of transgenic C2c1 animals, guide RNA of the invention may be delivered and the optrode technology can allow for the modulation of gene expression in precise brain regions. A transparent C2c1 expressing organism can have guide RNA of the invention administered to it and then there can be extremely precise laser induced local gene expression changes.

A culture medium for culturing host cells includes a medium commonly used for tissue culture, such as M199-earle base, Eagle MEM (E-MEM), Dulbecco MEM (DMEM), SC-UCM102, UP-SFM (GIBCO BRL), EX-CELL302 (Nichirei), EX-CELL293-S(Nichirei), TFBM-01 (Nichirei), ASF104, among others. Suitable culture media for specific cell types may be found at the American Type Culture Collection (ATCC) or the European Collection of Cell Cultures (ECACC). Culture media may be supplemented with amino acids such as L-glutamine, salts, anti-fungal or anti-bacterial agents such as Fungizone®, penicillin-streptomycin, animal serum, and the like. The cell culture medium may optionally be serum-free.

The invention may also offer valuable temporal precision in vivo. The invention may be used to alter gene expression during a particular stage of development. The invention may be used to time a genetic cue to a particular experimental window. For example, genes implicated in learning may be overexpressed or repressed only during the learning stimulus in a precise region of the intact rodent or primate brain. Further, the invention may be used to induce gene expression changes only during particular stages of disease development. For example, an oncogene may be overexpressed only once a tumor reaches a particular size or metastatic stage. Conversely, proteins suspected in the development of Alzheimer's may be knocked down only at defined time points in the animal's life and within a particular brain region. Although these examples do not exhaustively list the potential applications of the invention, they highlight some of the areas in which the invention may be a powerful technology.

Protected Guides

In particular embodiments, the guide molecule is modified by a secondary structure to increase the specificity of the CRISPR-Cas system and the secondary structure can protect against exonuclease activity and allow for 5' additions to the guide sequence also referred to herein as a protected guide molecule.

In one aspect, the invention provides for hybridizing a "protector RNA" to a sequence of the guide molecule, wherein the "protector RNA" is an RNA strand complementary to the 3' end of the guide molecule to thereby generate a partially double-stranded guide RNA. In an embodiment of the invention, protecting mismatched bases (i.e., the bases of the guide molecule which do not form part of the guide sequence) with a perfectly complementary protector sequence decreases the likelihood of target DNA binding to the mismatched base pairs at the 3' end. In particular embodiments of the invention, additional sequences comprising an extended length may also be present within the guide molecule such that the guide comprises a protector sequence within the guide molecule. This "protector sequence" ensures that the guide molecule comprises a "protected sequence" in addition to an "exposed sequence" (comprising the part of the guide sequence hybridizing to the target sequence). In particular embodiments, the guide molecule is modified by the presence of the protector guide to comprise a secondary structure such as a hairpin. Advantageously there are three or four to thirty or more, e.g., about 10 or more, contiguous base pairs having complementarity to the protected sequence, the guide sequence or both. It is advantageous that the protected portion does not impede thermodynamics of the CRISPR-Cas system interacting with its target. By providing such an extension including a partially double stranded guide molecule, the guide molecule is considered protected and results in improved specific binding of the CRISPR-Cas complex, while maintaining specific activity.

Guide RNA (gRNA) extensions matching the genomic target provide gRNA protection and enhance specificity. Extension of the gRNA with matching sequence distal to the end of the spacer seed for individual genomic targets is envisaged to provide enhanced specificity. Matching gRNA extensions that enhance specificity have been observed in cells without truncation. Prediction of gRNA structure accompanying these stable length extensions has shown that stable forms arise from protective states, where the extension forms a closed loop with the gRNA seed due to complimentary sequences in the spacer extension and the spacer seed. These results demonstrate that the protected guide concept also includes sequences matching the genomic target sequence distal of the 20mer spacer-binding region. Thermodynamic prediction can be used to predict completely matching or partially matching guide extensions that result in protected gRNA states. This extends the concept of protected gRNAs to interaction between X and Z, where X will generally be of length 17-20nt and Z is of length 1-30nt. Thermodynamic prediction can be used to determine the optimal extension state for Z, potentially introducing small numbers of mismatches in Z to promote the formation of protected conformations between X and Z. Throughout the present application, the terms “X” and seed length (SL) are used interchangeably with the term exposed length (EpL), which denotes the number of nucleotides available for target DNA to bind; the terms “Y” and protector length (PL) are used interchangeably to represent the length of the protector; and the terms “Z”, “E”, and “EL” are used interchangeably to correspond to the term extended length (ExL), which represents the number of nucleotides by which the target sequence is extended.

An extension sequence which corresponds to the extended length (ExL) may optionally be attached directly to the guide sequence at the 3' end of the protected guide sequence. The extension sequence may be 2 to 12 nucleotides in length. Preferably ExL may be denoted as 0, 2, 4, 6, 8, 10 or 12 nucleotides in length. In a preferred embodiment, the ExL is denoted as 0 or 4 nucleotides in length. In a more preferred embodiment, the ExL is 4 nucleotides in length. The extension sequence may or may not be complementary to the target sequence.

An extension sequence may further optionally be attached directly to the guide sequence at the 5' end of the protected guide sequence as well as to the 3' end of a protecting sequence. As a result, the extension sequence serves as a linking sequence between the protected sequence and the protecting sequence. Without wishing to be bound by theory, such a link may position the protecting sequence near the protected sequence for improved binding of the protecting sequence to the protected sequence. It will be understood that the above-described relationship of seed, protector, and extension applies where the distal end (i.e., the targeting end) of the guide is the 5' end, e.g., a guide that functions in a Cas system. In an embodiment wherein the distal end of the guide is the 3' end, the relationship will be the reverse. In such an embodiment, the invention provides for hybridizing a “protector RNA” to a guide sequence, wherein the “protector RNA” is an RNA strand complementary to the 3' end of the guide RNA (gRNA), to thereby generate a partially double-stranded gRNA.

Addition of gRNA mismatches to the distal end of the gRNA can demonstrate enhanced specificity. The introduction of unprotected distal mismatches in Y or extension of the gRNA with distal mismatches (Z) can demonstrate enhanced specificity. This concept as mentioned is tied to X, Y, and Z components used in protected gRNAs. The unprotected mismatch concept may be further generalized to the concepts of X, Y, and Z described for protected guide RNAs.

tru-Guides

In particular embodiments, use is made of a truncated guide (tru-guide), i.e., a guide molecule which comprises a guide sequence which is truncated in length with respect to the canonical guide sequence length. As described by Nowak et al. (Nucleic Acids Res (2016) 44 (20): 9555-9564), such guides may allow catalytically active CRISPR-Cas enzymes to bind its target without cleaving the target DNA. In particular embodiments, a truncated guide is used, which allows the binding of the target but retains only nickase activity of the CRISPR-Cas enzyme.

In a particular embodiment, the guide molecule comprises a guide sequence linked to a direct repeat sequence, or a guide sequence linked to a direct repeat sequence and a tracr sequence, wherein the direct repeat sequence, the crRNA sequence, and/or the tracr sequence comprises one or more stem loops or optimized secondary structures. In particular embodiments, the direct repeat has a minimum length of 16 nts and a single stem loop. In further embodiments, the direct repeat has a length longer than 16 nts, preferably more than 17 nts, and has more than one stem loops or optimized secondary structures. In particular embodiments, the guide molecule comprises or consists of the guide sequence linked to all or part of the natural direct repeat sequence. A typical Type V-B C2c1/Cas12b guide molecule comprises (in 3' to 5' direction): a guide sequence and a complimentary stretch (the “repeat”), complementary to the 3' end of a tracr. The repeat and the tracr may be joined into a chimeric guide comprising a region designed to form a stem-loop (the loop typically 4 or 5 nucleotides long), including second complimentary stretch (the “anti-repeat” of a tracr being complimentary to the repeat), and a poly A (often poly U in RNA) tail (terminator). In particular embodiments, certain aspects of the guide architecture can be modified, for example by addition, subtraction, or substitution of features, whereas certain other aspects of guide architecture are maintained. Preferred locations for engineered guide molecule modifications, include, but are not limited to, insertions, deletions, and substitutions including at guide termini and regions of the guide molecule that are exposed when complexed with the C2c1 protein and/or target, for example the stem-loop of the direct repeat sequence.

Chimeric Guides

The invention provides a variety of Cas12b system guides. In certain embodiments, the guides comprise two hybridizable parts, the 3' end of the first part being at least partially complementary to and capable of hybridizing with the 5' end of the second part. In certain embodiments, the two parts are joined. That is, a single guide (“chimeric guide”) can be employed comprising a first segment at the 5' end corresponding to the guide sequence and direct repeat of a natural Cas12b guide, joined to a second segment at the 3' end corresponding to the Cas12b tracr sequence. The two segments are joined such that the complementary sequences of the 3' end of the first segment and the 5' end of the second segment can hybridize, for example in a stem-loop structure.

Dead Guides

In one aspect, the invention provides guide sequences which are modified in a manner which allows for formation of the CRISPR complex and successful binding to the target, while at the same time, not allowing for successful nuclease activity (i.e., without nuclease activity/without indel activity). For matters of explanation, such modified guide sequences are referred to as “dead guides” or “dead guide sequences”. These dead guides or dead guide sequences can be thought of as catalytically inactive or conformationally inactive with regard to nuclease activity. Nuclease activity may be measured using surveyor analysis or deep sequencing as commonly used in the art, preferably surveyor analysis. Similarly, dead guide sequences may not sufficiently engage in productive base pairing with respect to the ability to promote catalytic activity or to distinguish on-target and off-target binding activity. Briefly, the surveyor assay involves purifying and amplifying a CRISPR target site for a gene and forming heteroduplexes with primers amplifying the CRISPR target site. After re-anneal, the products are treated with SURVEYOR nuclease and SURVEYOR enhancer S (Transgenomics) following the manufacturer's recommended protocols, analyzed on gels, and quantified based upon relative band intensities.

Hence, in a related aspect, the invention provides a non-naturally occurring or engineered composition C2c1 CRISPR-Cas system comprising a functional Cas12b as described herein, and guide RNA (gRNA), wherein the gRNA comprises a dead guide sequence, whereby the gRNA is capable of hybridizing to a target sequence such that the Cas12b CRISPR-Cas system is directed to a genomic locus of interest in a cell without detectable indel activity resultant from nuclease activity of a non-mutant Cas12b enzyme of the system as detected by a SURVEYOR assay. For shorthand purposes, a gRNA comprising a dead guide sequence, whereby the gRNA is capable of hybridizing to a target sequence such that the Cas12b CRISPR-Cas system is directed to a genomic locus of interest in a cell without detectable indel activity resultant from nuclease activity of a non-mutant Cas12b enzyme of the system as detected by a SURVEYOR assay, is herein termed a "dead gRNA". It is to be understood that any of the gRNAs according to the invention as described herein elsewhere may be used as dead gRNAs/gRNAs comprising a dead guide sequence as described herein below. Any of the methods, products, compositions and uses as described herein elsewhere are equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to a target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are shorter than respective guide sequences, which result in active Cas12b-specific indel formation. Dead guides are 5%, 10%, 20%, 30%, 40%, or 50% shorter than respective guides directed to the same Cas12b leading to active Cas12b-specific indel formation.

As explained below and known in the art, one aspect of gRNA-C2c1 specificity is the direct repeat sequence, which is to be appropriately linked to such guides. In particular, this implies that the direct repeat sequences are designed dependent on the origin of the C2c1. Thus, structural data available for validated dead guide sequences may be used for designing C2c1 specific equivalents. Structural similarity between, e.g., the orthologous nuclease domains RuvC of two or more C2c1 effector proteins may be used to transfer design equivalent dead guides. Thus, the dead guide herein may be appropriately modified in length and sequence to reflect such C2c1 specific equivalents, allowing for formation of the CRISPR complex and successful binding to the target, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting and, in particular, bidirectional multiplex gene targeting. Prior to the use of dead guides, addressing multiple targets, for example for activation, repression and/or silencing of gene activity, has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides now allow for the first time to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g., aptamers) as described herein elsewhere allowing for functional placement of gene effectors (e.g., activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble a synthetic transcription activation complex consisting of multiple distinct effector domains. Such may be modeled after natural transcription activation processes. For example, an aptamer, which selectively binds an effector (e.g., an activator or repressor; dimerized MS2 bacteriophage coat proteins as fusion proteins with an activator or repressor), or a protein which itself binds an effector (e.g., activator or repressor) may be appended to a dead gRNA tetraloop and/or a stem-loop 2. In the case of MS2, the fusion protein MS2-VP64 binds to the tetraloop and/or stem-loop 2 and in turn mediates transcriptional up-regulation, for example for Neurog2. Other transcriptional activators are, for example, VP64, P65, HSF1, and MyoD1. By mere example of this concept, replacement of the MS2 stem-loops with PP7-interacting stem-loops may be used to recruit repressive elements.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein, which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The gene effectors, gene activators, gene repressors may be present in the form of fusion proteins.

In an embodiment, the dead gRNA as described herein or the C2c1 CRISPR-Cas complex as described herein includes a non-naturally occurring or engineered composition comprising two or more adaptor proteins, wherein each protein is associated with one or more functional domains and wherein the adaptor protein binds to the distinct RNA sequence(s) inserted into the at least one loop of the dead gRNA.

Hence, an aspect provides a non-naturally occurring or engineered composition comprising a guide RNA (gRNA) comprising a dead guide sequence capable of hybridizing to a target sequence in a genomic locus of interest in a cell, wherein the dead guide sequence is as defined herein, a C2c1 comprising at least one or more nuclear localization sequences, wherein the C2c1 optionally comprises at least one mutation, wherein at least one loop of the dead gRNA is modified by the insertion of distinct RNA sequence(s) that bind to one or more adaptor proteins, and wherein the adaptor protein is associated with one or more functional domains; or, wherein the dead gRNA is modified to have at least one non-coding functional loop, and wherein the composition comprises two or more adaptor proteins, wherein each protein is associated with one or more functional domains.

In certain embodiments, the adaptor protein is a fusion protein comprising the functional domain, the fusion protein optionally comprising a linker between the adaptor protein and the functional domain, the linker optionally including a GlySer linker.

In certain embodiments, the at least one loop of the dead gRNA is not modified by the insertion of distinct RNA sequence(s) that bind to the two or more adaptor proteins.

In certain embodiments, the one or more functional domains associated with the adaptor protein is a transcriptional activation domain.

In certain embodiments, the one or more functional domains associated with the adaptor protein is a transcriptional activation domain comprising VP64, p65, MyoD1, HSF1, RTA or SET7/9.

In certain embodiments, the one or more functional domains associated with the adaptor protein is a transcriptional repressor domain.

In certain embodiments, the transcriptional repressor domain is a KRAB domain.

In certain embodiments, the transcriptional repressor domain is a NuE domain, NcoR domain, SID domain or a SID4X domain.

In certain embodiments, at least one of the one or more functional domains associated with the adaptor protein have one or more activities comprising methylase activity, demethylase activity, transcription activation activity, transcription repression activity, transcription release factor activity, histone modification activity, DNA integration activity, RNA cleavage activity, DNA cleavage activity or nucleic acid binding activity.

In certain embodiments, the DNA cleavage activity is due to a Fok1 nuclease.

In certain embodiments, the dead gRNA is modified so that, after dead gRNA binds the adaptor protein and further binds to the C2c1 and target, the functional domain is in a spatial orientation allowing for the functional domain to function in its attributed function.

In certain embodiments, the at least one loop of the dead gRNA is tetra loop and/or loop 2. In certain embodiments, the tetra loop and loop 2 of the dead gRNA are modified by the insertion of the distinct RNA sequence(s).

In certain embodiments, the insertion of distinct RNA sequence(s) that bind to one or more adaptor proteins is an aptamer sequence. In certain embodiments, the aptamer sequence is two or more aptamer sequences specific to the same adaptor protein. In certain embodiments, the aptamer sequence is two or more aptamer sequences specific to different adaptor protein.

In certain embodiments, the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s, PRR1.

In certain embodiments, the cell is a eukaryotic cell. In certain embodiments, the eukaryotic cell is a mammalian cell, optionally a mouse cell. In certain embodiments, the mammalian cell is a human cell.

In certain embodiments, a first adaptor protein is associated with a p65 domain and a second adaptor protein is associated with a HSF1 domain.

In certain embodiments, the composition comprises a C2c1 CRISPR-Cas complex having at least three functional domains, at least one of which is associated with the C2c1 and at least two of which are associated with dead gRNA.

In certain embodiments, the composition further comprises a second gRNA, wherein the second gRNA is a live gRNA capable of hybridizing to a second target sequence such that a second C2c1 CRISPR-Cas system is directed to a second genomic locus of interest in a cell with detectable indel activity at the second genomic locus resultant from nuclease activity of the C2c1 enzyme of the system.

In certain embodiments, the composition further comprises a plurality of dead gRNAs and/or a plurality of live gRNAs.

One aspect of the invention is to take advantage of the modularity and customizability of the gRNA scaffold to establish a series of gRNA scaffolds with different binding sites (in particular aptamers) for recruiting distinct types of effectors in an orthogonal manner. Again, for matters of example and illustration of the broader concept, replacement of the MS2 stem-loops with PP7-interacting stem-loops may be used to bind/recruit repressive elements, enabling multiplexed bidirectional transcriptional control. Thus, in general, gRNA comprising a dead guide may be employed to provide for multiplex transcriptional control and preferred bidirectional transcriptional control. This transcriptional control is most preferred of genes. For example, one or more gRNA comprising dead guide(s) may be employed in targeting the activation of one or more target genes. At the same time, one or more gRNA comprising dead guide(s) may be employed in targeting the repression of one or more target genes. Such a sequence may be applied in a variety of different combinations, for example the target genes are first repressed and then at an appropriate period other targets are activated, or select genes are repressed at the same time as select genes are activated, followed by further activation and/or repression. As a result, multiple components of one or more biological systems may advantageously be addressed together.

In an aspect, the invention provides nucleic acid molecule(s) encoding dead gRNA or the C2c1 CRISPR-Cas complex or the composition as described herein.

In an aspect, the invention provides a vector system comprising: a nucleic acid molecule encoding dead guide RNA as defined herein. In certain embodiments, the vector system further comprises a nucleic acid molecule(s) encoding C2c1. In certain embodiments, the vector system further comprises a nucleic acid molecule(s) encoding (live) gRNA. In certain embodiments, the nucleic acid molecule or the vector further comprises regulatory element(s) operable in a eukaryotic cell operably linked to the nucleic acid molecule encoding the guide sequence (gRNA) and/or the nucleic acid molecule encoding C2c1 and/or the optional nuclear localization sequence(s).

In another aspect, structural analysis may also be used to study interactions between the dead guide and the active C2c1 nuclease that enable DNA binding, but no DNA cutting. In this way, amino acids important for nuclease activity of C2c1 are determined. Modification of such amino acids allows for improved C2c1 enzymes used for gene editing.

A further aspect is combining the use of dead guides as explained herein with other applications of CRISPR, as explained herein as well as known in the art. For example, gRNA comprising dead guide(s) for targeted multiplex gene activation or repression, or targeted multiplex bidirectional gene activation/repression may be combined with gRNA comprising guides which maintain nuclease activity, as explained herein. Such gRNA comprising guides which maintain nuclease activity may or may not further include modifications which allow for repression of gene activity (e.g., aptamers). Such gRNA comprising guides which maintain nuclease activity may or may not further include modifications which allow for activation of gene activity (e.g., aptamers). In such a manner, a further means for multiplex gene control is introduced (e.g., multiplex gene targeted activation without nuclease activity/without indel activity may be provided at the same time or in combination with gene targeted repression with nuclease activity).

For example, 1) using one or more gRNA (e.g., 1-50, 1-40, 1-30, 1-20, preferably 1-10, more preferably 1-5) comprising dead guide(s) targeted to one or more genes and further modified with appropriate aptamers for the recruitment of gene activators; 2) may be combined with one or more gRNA (e.g., 1-50, 1-40, 1-30, 1-20, preferably 1-10, more preferably 1-5) comprising dead guide(s) targeted to one or more genes and further modified with appropriate aptamers for the recruitment of gene repressors. 1) and/or 2) may then be combined with 3) one or more gRNA (e.g., 1-50, 1-40, 1-30, 1-20, preferably 1-10, more preferably 1-5) targeted to one or more genes. This combination can then be carried out in turn with 1)+2)+3) with 4) one or more gRNA (e.g., 1-50, 1-40, 1-30, 1-20, preferably 1-10, more preferably 1-5) targeted to one or more genes and further modified with appropriate aptamers for the recruitment of gene activators. This combination can then be carried in turn with 1)+2)+3)+4) with 5) one or more gRNA (e.g., 1-50, 1-40, 1-30, 1-20, preferably 1-10, more preferably 1-5) targeted to one or more genes and further modified with appropriate aptamers for the recruitment of gene repressors. As a result, various uses and combinations are included in the invention. For example, combination 1)+2); combination 1)+3); combination 2)+3); combination 1)+2)+3); combination 1)+2)+3)+4); combination 1)+3)+4); combination 2)+3)+4); combination 1)+2)+4); combination 1)+2)+3)+4)+5); combination 1)+3)+4)+5); combination 2)+3)+4)+5); combination 1)+2)+4)+5); combination 1)+2)+3)+5); combination 1)+3)+5); combination 2)+3)+5); combination 1)+2)+5).

In an aspect, the invention provides an algorithm for designing, evaluating, or selecting a dead guide RNA targeting sequence (dead guide sequence) for guiding a C2c1 CRISPR-Cas system to a target gene locus. In particular, it has been determined that dead guide RNA specificity relates to and can be optimized by varying i) GC content and ii) targeting sequence length. In an aspect, the invention provides an algorithm for designing or evaluating a dead guide RNA targeting sequence that minimizes off-target binding or interaction of the dead guide RNA. In an embodiment of the invention, the algorithm for selecting a dead guide RNA targeting sequence for directing a CRISPR system to a gene locus in an organism comprises a) locating one or more CRISPR motifs in the gene locus; b) analyzing the 20 nt sequence downstream of each CRISPR motif by i) determining the GC content of the sequence, and ii) determining whether there are off-target matches of the 15 downstream nucleotides nearest to the CRISPR motif in the genome of the organism; and c) selecting the 15 nucleotide sequence for use in a dead guide RNA if the GC content of the sequence is 70% or less and no off-target matches are identified. In an embodiment, the sequence is selected for a targeting sequence if the GC content is 60% or less. In certain embodiments, the sequence is selected for a targeting sequence if the GC content is 55% or less, 50% or less, 45% or less, 40% or less, 35% or less, or 30% or less. In an embodiment, two or more sequences of the gene locus are analyzed and the sequence having the lowest GC content, or the next lowest GC content, or the next lowest GC content is selected. In an embodiment, the sequence is selected for a targeting sequence if no off-target matches are identified in the genome of the organism. In an embodiment, the targeting sequence is selected if no off-target matches are identified in regulatory sequences of the genome.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less, or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment, the first 12 nt of the dead guide match the target sequence. In another embodiment, the first 11 nt of the dead guide match the target sequence. In another embodiment, the first 10 nt of the dead guide match the target sequence. In an embodiment of the invention, the first 15 nt of the dead guide does not match an off-target sequence downstream from a CRISPR motif in the regulatory region of another gene locus. In other embodiments, the first 14 nt, or the first 13 nt, or the first 12 nt, or the first 11 nt, or the first 10 nt of the dead guide does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 15 nt, or 14 nt, or 13 nt, or 12 nt, or 11 nt downstream of a CRISPR motif can be extended in length at the 3' end to 12 nt, 13 nt, 14 nt, 15 nt, 16 nt, 17 nt, 18 nt, 19 nt, 20 nt, or longer.

The invention provides a method for directing a C2c1 CRISPR-Cas system, including, but not limited to, a dead C2c1 (dC2c1) or functionalized C2c1 system (which may comprise a functionalized C2c1 or functionalized guide) to a gene locus. In an aspect, the invention provides a method for selecting a dead guide RNA targeting sequence and directing a functionalized CRISPR system to a gene locus in an organism. In an aspect, the invention provides a method for selecting a dead guide RNA targeting sequence and effecting gene regulation of a target gene locus by a functionalized C2c1 CRISPR-Cas system. In certain embodiments, the method is used to effect target gene regulation while minimizing off-target effects. In an aspect, the invention provides a method for selecting two or more dead guide RNA targeting sequences and effecting gene regulation of two or more target gene loci by a functionalized C2c1 CRISPR-Cas system. In certain embodiments, the method is used to effect regulation of two or more target gene loci while minimizing off-target effects.

In an aspect, the invention provides a method of selecting a dead guide RNA targeting sequence for directing a functionalized C2c1 to a gene locus in an organism, which comprises: a) locating one or more CRISPR motifs in the gene locus; b) analyzing the sequence downstream of each CRISPR motif by: i) selecting 10 to 15 nt adjacent to the CRISPR motif, ii) determining the GC content of the sequence; and c) selecting the 10 to 15 nt sequence as a targeting sequence for use in a guide RNA if the GC content of the sequence is 40% or more. In an embodiment, the sequence is selected if the GC content is 50% or more. In an embodiment, the sequence is selected if the GC content is 60% or more. In an embodiment, the sequence is selected if the GC content is 70% or more. In an embodiment, two or more sequences are analyzed and the sequence having the highest GC content is selected. In an embodiment, the method further comprises adding nucleotides to the 3' end of the selected sequence which do not match the sequence downstream of the CRISPR motif. An aspect provides a dead guide RNA comprising the targeting sequence selected according to the aforementioned methods.

In an aspect, the invention provides a dead guide RNA for directing a functionalized CRISPR system to a gene locus in an organism wherein the targeting sequence of the dead guide RNA consists of 10 to 15 nucleotides adjacent to the CRISPR motif of the gene locus, wherein the CG content of the target sequence is 50% or more. In certain embodiments, the dead guide RNA further comprises nucleotides added to the 3' end of the targeting sequence which do not match the sequence downstream of the CRISPR motif of the gene locus.

In an aspect, the invention provides for a single effector to be directed to one or more, or two or more gene loci. In certain embodiments, the effector is associated with a C2c1, and one or more, or two or more selected dead guide RNAs are used to direct the C2c1-associated effector to one or more, or two or more selected target gene loci. In certain embodiments, the effector is associated with one or more, or two or more selected dead guide RNAs, each selected dead guide RNA, when complexed with a C2c1 enzyme, causing its associated effector to localize to the dead guide RNA target. One non-limiting example of such CRISPR systems modulates activity of one or more, or two or more gene loci subject to regulation by the same transcription factor.

In an aspect, the invention provides for two or more effectors to be directed to one or more gene loci. In certain embodiments, two or more dead guide RNAs are employed, each of the two or more effectors being associated with a selected dead guide RNA, with each of the two or more effectors being localized to the selected target of its dead guide RNA. One non-limiting example of such CRISPR systems modulates activity of one or more, or two or more gene loci subject to regulation by different transcription factors. Thus, in one non-limiting embodiment, two or more transcription factors are localized to different regulatory sequences of a single gene. In another non-limiting embodiment, two or more transcription factors are localized to different regulatory sequences of different genes. In certain embodiments, one transcription factor is an activator. In certain embodiments, one transcription factor is an inhibitor. In certain embodiments, one transcription factor is an activator and another transcription factor is an inhibitor. In certain embodiments, gene loci expressing different components of the same regulatory pathway are regulated. In certain embodiments, gene loci expressing components of different regulatory pathways are regulated.

In an aspect, the invention also provides a method and algorithm for designing and selecting dead guide RNAs that are specific for target DNA cleavage or target binding and gene regulation mediated by an active C2c1 CRISPR-Cas system. In certain embodiments, the C2c1 CRISPR-Cas system provides orthogonal gene control using an active C2c1, which cleaves target DNA at one gene locus while at the same time binds to and promotes regulation of another gene locus.

In an aspect, the invention provides a method of selecting a dead guide RNA targeting sequence for directing a functionalized Cas12b to a gene locus in an organism, without cleavage. In certain embodiments, the method comprises a) locating one or more CRISPR motifs in the gene locus; b) analyzing the sequence downstream of each CRISPR motif by i) selecting 10 to 15 nt adjacent to the CRISPR motif, ii) determining the GC content of the sequence; and c) selecting the 10 to 15 nt sequence as a targeting sequence for use in a dead guide RNA if the GC content of the sequence is 30% more, or 40% or more. In certain embodiments, the GC content of the targeting sequence is 35% or more, 40% or more, 45% or more, 50% or more, 55% or more, 60% or more, 65% or more, or 70% or more. In certain embodiments, the GC content of the targeting sequence is from 30% to 40% or from 40% to 50% or from 50% to 60% or from 60% to 70%. In an embodiment of the invention, two or more sequences in a gene locus are analyzed and the sequence having the highest GC content is selected.

In an embodiment of the invention, the portion of the targeting sequence in which GC content is evaluated is 10 to 15 contiguous nucleotides of the 15 target nucleotides nearest to the PAM. In an embodiment of the invention, the portion of the guide in which GC content is considered is the 10 to 11 nucleotides or 11 to 12 nucleotides or 12 to 13 nucleotides or 13, or 14, or 15 contiguous nucleotides of the 15 nucleotides nearest to the PAM.

In an aspect, the invention further provides an algorithm for identifying dead guide RNAs which promote CRISPR system gene locus cleavage while avoiding functional activation or inhibition. It is observed that increased GC content in dead guide RNAs of 16 to 20 nucleotides coincides with increased DNA cleavage and reduced functional activation.

Efficiency of functionalized Cas12b can be increased by addition of nucleotides to the 3' end of a guide RNA which do not match a target sequence downstream of the CRISPR motif. For example, of dead guide RNA 11 to 15 nt in length, shorter guides may be less likely to promote target cleavage, but are also less efficient at promoting CRISPR system binding and functional control. In certain embodiments, addition of nucleotides that don't match the target sequence to the 3' end of the dead guide RNA increase activation efficiency while not increasing undesired target cleavage. In an aspect, the invention also provides a method and algorithm for identifying improved dead guide RNAs that effectively promote CRISPR system function in DNA binding and gene regulation while not promoting DNA cleavage. Thus, in certain embodiments, the invention provides a dead guide RNA that includes the first 15 nt, or 14 nt, or 13 nt, or 12 nt, or 11 nt downstream of a CRISPR motif and is extended in length at the 3' end by nucleotides that mismatch the target to 12 nt, 13 nt, 14 nt, 15 nt, 16 nt, 17 nt, 18 nt, 19 nt, 20 nt, or longer.

In an aspect, the invention provides a method for effecting selective orthogonal gene control. As will be appreciated from the disclosure herein, dead guide selection according to the invention, taking into account guide length and GC content, provides effective and selective transcription control by a functional Cas12b CRISPR-Cas system, for example to regulate transcription of a gene locus by activation or inhibition and minimize off-target effects. Accordingly, by providing effective regulation of individual target loci, the invention also provides effective orthogonal regulation of two or more target loci.

In certain embodiments, orthogonal gene control is by activation or inhibition of two or more target loci. In certain embodiments, orthogonal gene control is by activation or inhibition of one or more target locus and cleavage of one or more target locus.

In one aspect, the invention provides a cell comprising a non-naturally occurring Cas12b CRISPR-Cas system comprising one or more dead guide RNAs disclosed or made according to a method or algorithm described herein wherein the expression of one or more gene products has been altered. In an embodiment of the invention, the expression in the cell of two or more gene products has been altered. The invention also provides a cell line from such a cell.

In one aspect, the invention provides a multicellular organism comprising one or more cells comprising a non-naturally occurring Cas12b CRISPR-Cas system comprising one or more dead guide RNAs disclosed or made according to a method or algorithm described herein. In one aspect, the invention provides a product from a cell, cell line, or multicellular organism comprising a non-naturally occurring Cas12b CRISPR-Cas system comprising one or more dead guide RNAs disclosed or made according to a method or algorithm described herein.

A further aspect of this invention is the use of gRNA comprising dead guide(s) as described herein, optionally in combination with gRNA comprising guide(s) as described herein or in the state of the art, in combination with systems (e.g., cells, transgenic animals, transgenic mice, inducible transgenic animals, inducible transgenic mice) which are engineered for either overexpression of Cas12b or preferably knock in Cas12b. As a result, a single system (e.g., transgenic animal, cell) can serve as a basis for multiplex gene modifications in systems/network biology. On account of the dead guides, this is now possible in both in vitro, ex vivo, and in vivo.

For example, once the Cas12b is provided for, one or more dead gRNAs may be provided to direct multiplex gene regulation, and preferably multiplex bidirectional gene regulation. The one or more dead gRNAs may be provided in a spatially and temporally appropriate manner if necessary or desired (for example tissue specific induction of Cas12b expression). On account that the transgenic/inducible Cas12b is provided for (e.g., expressed) in the cell, tissue, animal of interest, both gRNAs comprising dead guides or gRNAs comprising guides are equally effective. In the same manner, a further aspect of this invention is the use of gRNA comprising dead guide(s) as described herein, optionally in combination with gRNA comprising guide(s) as described herein or in the state of the art, in combination with systems (e.g., cells, transgenic animals, transgenic mice, inducible transgenic animals, inducible transgenic mice) which are engineered for knockout Cas12b CRISPR-Cas.

As a result, the combination of dead guides as described herein with CRISPR applications described herein and CRISPR applications known in the art results in a highly efficient and accurate means for multiplex screening of systems (e.g., network biology). Such screening allows, for example, identification of specific combinations of gene activities for identifying genes responsible for diseases (e.g., on/off combinations), in particular gene related diseases. A preferred application of such screening is cancer. In the same manner, screening for treatment for such diseases is included in the invention. Cells or animals may be exposed to aberrant conditions resulting in disease or disease like effects. Candidate compositions may be provided and screened for an effect in the desired multiplex environment. For example, a patient's cancer cells may be screened for which gene combinations will cause them to die, and then use this information to establish appropriate therapies.

In one aspect, the invention provides a kit comprising one or more of the components described herein. The kit may include dead guides as described herein with or without guides as described herein.

The structural information provided herein allows for interrogation of dead gRNA interaction with the target DNA and the Cas12b permitting engineering or alteration of dead gRNA structure to optimize functionality of the entire Cas12b CRISPR-Cas system. For example, loops of the dead gRNA may be extended without colliding with the Cas12b protein by the insertion of adaptor proteins that can bind to RNA. These adaptor proteins can further recruit effector proteins or fusions which comprise one or more functional domains.

In some preferred embodiments, the functional domain is a transcriptional activation domain, preferably VP64. In some embodiments, the functional domain is a transcription repression domain, preferably KRAB. In some embodiments, the transcription repression domain is SID, or concatemers of SID (e.g., SID4X). In some embodiments, the functional domain is an epigenetic modifying domain, such that an epigenetic modifying enzyme is provided. In some embodiments, the functional domain is an activation domain, which may be the P65 activation domain. In some embodiments, the Cas12b effector protein is associated with one or more functional domains; and the Cas12b effector protein contains one or more mutations within a RuvC and/or Nuc domain, whereby the formed CRISPR complex is capable of delivering an epigenetic modifier or a transcriptional or translational activation or repression signal.

An aspect of the invention is that the above elements are comprised in a single composition or comprised in individual compositions. These compositions may advantageously be applied to a host to elicit a functional effect on the genomic level.

In general, the dead gRNA are modified in a manner that provides specific binding sites (e.g., aptamers) for adapter proteins comprising one or more functional domains (e.g., via fusion protein) to bind to. The modified dead gRNA are modified such that once the dead gRNA forms a CRISPR complex (i.e., Cas12b binding to dead gRNA and target) the adapter proteins bind and, the functional domain on the adapter protein is positioned in a spatial orientation which is advantageous for the attributed function to be effective. For example, if the functional domain is a transcription activator (e.g., VP64 or P65), the transcription activator is placed in a spatial orientation that allows it to affect the transcription of the target. Likewise, a transcription repressor will be advantageously positioned to affect the transcription of the target and a nuclease (e.g., Fok1) will be advantageously positioned to cleave or partially cleave the target.

The skilled person will understand that modifications to the dead gRNA which allow for binding of the adapter+ functional domain but not proper positioning of the adapter+ functional domain (e.g., due to steric hindrance within the three dimensional structure of the CRISPR complex) are modifications which are not intended.

As explained herein, the functional domains may be, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). In some cases it is advantageous that additionally at least one NLS is provided. In some instances, it is advantageous to position the NLS at the N terminus. When more than one functional domain is included, the functional domains may be the same or different.

The dead gRNA may be designed to include multiple binding recognition sites (e.g., aptamers) specific to the same or different adapter protein. The dead gRNA may be designed to bind to the promoter region −1000-+1 nucleic acids upstream of the transcription start site (i.e., TSS), preferably −200 nucleic acids. This positioning improves functional domains that affect gene activation (e.g., transcription activators) or gene inhibition (e.g., transcription repressors). The modified dead gRNA may be one or more modified dead gRNAs targeted to one or more target loci (e.g., at least 1 gRNA, at least 2 gRNA, at least 5 gRNA, at least 10 gRNA, at least 20 gRNA, at least 30 gRNA, at least 50 gRNA) comprised in a composition.

The adaptor protein may be any number of proteins that binds to an aptamer or recognition site introduced into the modified dead gRNA and which allows proper positioning of one or more functional domains, once the dead gRNA has been incorporated into the CRISPR complex, to affect the target with the attributed function. As explained in detail in this application, such may be coat proteins, preferably bacteriophage coat proteins. The functional domains associated with such adaptor proteins (e.g., in the form of fusion protein) may include, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Preferred domains are Fok1, VP64, P65, HSF1, and MyoD1. In the event that the functional domain is a transcription activator or transcription repressor, it is advantageous that additionally at least an NLS is provided and preferably at the N terminus. When more than one functional domain is included, the functional domains may be the same or different. The adaptor protein may utilize known linkers to attach such functional domains.

Thus, the modified dead gRNA, the (inactivated) Cas12b (with or without functional domains), and the binding protein with one or more functional domains may each individually be comprised in a composition and administered to a host individually or collectively. Alternatively, these components may be provided in a single composition for administration to a host. Administration to a host may be performed via viral vectors known to the skilled person or described herein for delivery to a host (e.g., lentiviral vector, adenoviral vector, AAV vector). As explained herein, use of different selection markers (e.g., for lentiviral gRNA selection) and concentration of gRNA (e.g., dependent on whether multiple gRNAs are used) may be advantageous for eliciting an improved effect.

On the basis of this concept, several variations are appropriate to elicit a genomic locus event, including DNA cleavage, gene activation, or gene deactivation. Using the provided compositions, the person skilled in the art can advantageously and specifically target single or multiple loci with the same or different functional domains to elicit one or more genomic locus events. The compositions may be applied in a wide variety of methods for screening in libraries in cells and functional modeling in vivo (e.g., gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR transgenic cell/animals, which are not believed prior to the present invention or application. For example, the target cell comprises Cas12b conditionally or inducibly (e.g., in the form of Cre dependent constructs) and/or the adapter protein conditionally or inducibly and, on expression of a vector introduced into the target cell, the vector expresses that which induces or gives rise to the condition of Cas12b expression and/or adaptor expression in the target cell. By applying the teaching and compositions of the current invention with the known method of creating a CRISPR complex, inducible genomic events affected by functional domains are also an aspect of the current invention. One example of this is the creation of a CRISPR knock-in/conditional transgenic animal (e.g., mouse comprising e.g., a Lox-Stop-polyA-Lox(LSL) cassette) and subsequent delivery of one or more compositions providing one or more modified dead gRNA (e.g., −200 nucleotides to TSS of a target gene of interest for gene activation purposes) as described herein (e.g., modified dead gRNA with one or more aptamers recognized by coat proteins, e.g., MS2), one or more adapter proteins as described herein (MS2 binding protein linked to one or more VP64) and means for inducing the conditional animal (e.g., Cre recombinase for rendering Cas12b expression inducible). Alternatively, the adaptor protein may be provided as a conditional or inducible element with a conditional or inducible Cas12b to provide an effective model for screening purposes, which advantageously only requires minimal design and administration of specific dead gRNAs for a broad number of applications.

In another aspect, the dead guides are further modified to improve specificity. Protected dead guides may be synthesized, whereby secondary structure is introduced into the 3' end of the dead guide to improve its specificity. A protected guide RNA (pgRNA) comprises a guide sequence capable of hybridizing to a target sequence in a genomic locus of interest in a cell and a protector strand, wherein the protector strand is optionally complementary to the guide sequence and wherein the guide sequence may in part be hybridizable to the protector strand. The pgRNA optionally includes an extension sequence. The thermodynamics of the pgRNA-target DNA hybridization is determined by the number of bases complementary between the guide RNA and target DNA. By employing 'thermodynamic protection', specificity of dead gRNA can be improved by adding a protector sequence. For example, one method adds a complementary protector strand of varying lengths to the 3' end of the guide sequence within the dead gRNA. As a result, the protector strand is bound to at least a portion of the dead gRNA and provides for a protected gRNA (pgRNA). In turn, the dead gRNA references herein may be easily protected using the described embodiments, resulting in pgRNA. The protector strand can be either a separate RNA transcript or strand or a chimeric version joined to the 3' end of the dead gRNA guide sequence.

The inventors have shown that CRISPR enzymes as defined herein can employ more than one RNA guide without losing activity. This enables the use of the CRISPR enzymes, systems or complexes as defined herein for targeting multiple DNA targets, genes or gene loci, with a single enzyme, system or complex as defined herein. The guide RNAs may be tandemly arranged and optionally separated by a nucleotide sequence, such as a direct repeat as defined herein. The position of the different guide RNAs in the tandem does not influence the activity.

Multiplex CRISPR-Cas Systems

In one aspect, the invention provides a non-naturally occurring or engineered CRISPR enzyme, preferably a class 2 CRISPR enzyme, preferably a Type V or VI CRISPR enzyme as described herein, such as, without limitation, Cas12b as described herein elsewhere, used for tandem or multiplex targeting. It is to be understood that any of the CRISPR (or CRISPR-Cas or Cas) enzymes, complexes, or systems according to the invention as described herein elsewhere may be used in such an approach. Any of the methods, products, compositions and uses as described herein elsewhere are equally applicable with the multiplex or tandem targeting approach further detailed below. By means of further guidance, the following particular aspects and embodiments are provided.

In one aspect, the invention provides for the use of a Cas12b enzyme, complex or system as defined herein for targeting multiple gene loci. In one embodiment, this can be established by using multiple (tandem or multiplex) guide RNA (gRNA) sequences.

In one aspect, the invention provides methods for using one or more elements of a Cas12b enzyme, complex or system as defined herein for tandem or multiplex targeting, wherein said CRISP system comprises multiple guide RNA sequences. Preferably, said gRNA sequences are separated by a nucleotide sequence, such as a direct repeat as defined herein elsewhere.

The Cas12b enzyme, system or complex as defined herein provides an effective means for modifying multiple target polynucleotides. The Cas12b enzyme, system or complex as defined herein has a wide variety of utility including modifying (e.g., deleting, inserting, translocating, inactivating, activating) one or more target polynucleotides in a multiplicity of cell types. As such, the Cas12b enzyme, system or complex as defined herein of the invention has a broad spectrum of applications in, e.g., gene therapy, drug screening, disease diagnosis, and prognosis, including targeting multiple gene loci within a single CRISPR system.

In one aspect, the invention provides a Cas12b enzyme, system or complex as defined herein, i.e., a Cas12b CRISPR-Cas complex having a Cas12b protein having at least one destabilization domain associated therewith, and multiple guide RNAs that target multiple nucleic acid molecules such as DNA molecules, whereby each of said multiple guide RNAs specifically targets its corresponding nucleic acid molecule, e.g., DNA molecule. Each nucleic acid molecule target, e.g., DNA molecule, can encode a gene product or encompass a gene locus. Using multiple guide RNAs hence enables the targeting of multiple gene loci or multiple genes. In some embodiments, the Cas12b enzyme may cleave the DNA molecule encoding the gene product. In some embodiments, expression of the gene product is altered. The Cas12b protein and the guide RNAs do not naturally occur together. The invention comprehends the guide RNAs comprising tandemly arranged guide sequences. The invention further comprehends coding sequences for the Cas12b protein being codon optimized for expression in a eukaryotic cell. In a preferred embodiment, the eukaryotic cell is a mammalian cell, a plant cell or a yeast cell and, in a more preferred embodiment, the mammalian cell is a human cell. Expression of the gene product may be decreased. The Cas12b enzyme may form part of a CRISPR system or complex, which further comprises tandemly arranged guide RNAs (gRNAs) comprising a series of 2, 3, 4, 5, 6, 7, 8, 9, 10, 15, 25, 25, 30, or more than 30 guide sequences, each capable of specifically hybridizing to a target sequence in a genomic locus of interest in a cell. In some embodiments, the functional Cas12b CRISPR system or complex binds to the multiple target sequences. In some embodiments, the functional CRISPR system or complex may edit the multiple target sequences, e.g., the target sequences may comprise a genomic locus, and, in some embodiments, there may be an alteration of gene expression. In some embodiments, the functional CRISPR system or complex may comprise further functional domains. In some embodiments, the invention provides a method for altering or modifying expression of multiple gene products. The method may comprise introducing into a cell containing said target nucleic acids, e.g., DNA molecules, or containing and expressing target nucleic acid, e.g., DNA molecules; for instance, the target nucleic acids may encode gene products or provide for expression of gene products (e.g., regulatory sequences).

In preferred embodiments, the CRISPR enzyme used for multiplex targeting is Cas12b, or the CRISPR system or complex comprises Cas12b. In some embodiments, the Cas12b enzyme used for multiplex targeting cleaves both strands of DNA to produce a double strand break (DSB). In some embodiments, the CRISPR enzyme used for multiplex targeting is a nickase. In some embodiments, the Cas12b enzyme used for multiplex targeting is a dual nickase. In some embodiments, the Cas12b enzyme used for multiplex targeting is a Cas12b enzyme, such as a DD Cas12b enzyme as defined herein elsewhere.

In some general embodiments, the Cas12b enzyme used for multiplex targeting is associated with one or more functional domains. In some more specific embodiments, the CRISPR enzyme used for multiplex targeting is a deadCas12b as defined herein elsewhere.

In an aspect, the present invention provides a means for delivering the Cas12b enzyme, system or complex for use in multiple targeting as defined herein or the polynucleotides defined herein. Non-limiting examples of such delivery means are e.g., particle(s) delivering component(s) of the complex, vector(s) comprising the polynucleotide(s) discussed herein (e.g., encoding the CRISPR enzyme, providing the nucleotides encoding the CRISPR complex). In some embodiments, the vector may be a plasmid or a viral vector such as AAV, or lentivirus. Transient transfection with plasmids, e.g., into HEK cells, may be advantageous, especially given the size limitations of AAV and that while Cas12b fits into AAV, one may reach an upper limit with additional guide RNAs.

Also provided is a model that constitutively expresses the Cas12b enzyme, complex or system as used herein for use in multiplex targeting. The organism may be transgenic and may have been transfected with the present vectors or may be the offspring of an organism so transfected. In a further aspect, the present invention provides compositions comprising the CRISPR enzyme, system and complex as defined herein or the polynucleotides or vectors described herein. Also provided are Cas12b CRISPR systems or complexes comprising multiple guide RNAs, preferably in a tandemly arranged format. Said different guide RNAs may be separated by nucleotide sequences such as direct repeats.

Also provided is a method of treating a subject, e.g., a subject in need thereof, comprising inducing gene editing by transforming the subject with the polynucleotide encoding the Cas12b CRISPR system or complex or any of polynucleotides or vectors described herein and administering them to the subject. A suitable repair template may also be provided, for example delivered by a vector comprising said repair template. Also provided is a method of treating a subject, e.g., a subject in need thereof, comprising inducing transcriptional activation or repression of multiple target gene loci by transforming the subject with the polynucleotides or vectors described herein, wherein said polynucleotide or vector encodes or comprises the Cas12b enzyme, complex or system comprising multiple guide RNAs, preferably tandemly arranged. Where any treatment is occurring ex vivo, for example in a cell culture, then it will be appreciated that the term 'subject' may be replaced by the phrase "cell or cell culture."

Compositions comprising Cas12b enzyme, complex or system comprising multiple guide RNAs, preferably tandemly arranged, or the polynucleotide or vector encoding or comprising said Cas12b enzyme, complex or system comprising multiple guide RNAs, preferably tandemly arranged, for use in the methods of treatment as defined herein elsewhere are also provided. A kit of parts may be provided including such compositions. Uses of said composition in the manufacture of a medicament for such methods of treatment are also provided. Use of a Cas12b CRISPR system in screening is also provided by the present invention, e.g., gain of function screens. Cells, which are artificially forced to overexpress a gene, are able to down regulate the gene over time (re-establishing equilibrium) e.g., by negative feedback loops. By the time the screen starts, the unregulated gene might be reduced again. Using an inducible Cas12b activator allows one to induce transcription right before the screen and therefore minimizes the chance of false negative hits. Accordingly, by use of the instant invention in screening, e.g., gain of function screens, the chance of false negative results may be minimized.

In one aspect, the invention provides an engineered, non-naturally occurring CRISPR system comprising a Cas12b protein and multiple guide RNAs that each specifically target a DNA molecule encoding a gene product in a cell, whereby the multiple guide RNAs each target their specific DNA molecule encoding the gene product and the Cas12b protein cleaves the target DNA molecule encoding the gene product, whereby expression of the gene product is altered; and, wherein the CRISPR protein and the guide RNAs do not naturally occur together. The invention comprehends the multiple guide RNAs comprising multiple guide sequences, preferably separated by a nucleotide sequence, such as a direct repeat and optionally fused to a tracr sequence. In an embodiment of the invention, the CRISPR protein is a type V or VI CRISPR-Cas protein and, in a more preferred embodiment, the CRISPR protein is a Cas12b protein. The invention further comprehends a Cas12b protein being codon optimized for expression in a eukaryotic cell. In a preferred embodiment, the eukaryotic cell is a mammalian cell, and, in a more preferred embodiment, the mammalian cell is a human cell. In a further embodiment of the invention, the expression of the gene product is decreased.

Modifying a Target Sequence

In certain embodiments, the locus of interest is modified by the CRISPR-C2c1 complex by inserting, or "knocking-in" a template DNA sequence. In particular embodiments, the DNA insert is designed to integrate into the genome in the proper orientation. In preferred embodiments, the locus of interest is modified by the CRISPR-C2c1 system in non-dividing cells, where genome editing via homology-directed repair (HDR) mechanisms are especially challenging (Chan et al., Nucleic acids research. 2011; 39:5955-5966). Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus that yielded up to 20% GFP+ cells in somatic LO2 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA-PAM sequences on both 3' and 5' ends. In preferred embodiments, the exogenous DNA is released after CRISPR-C2c1 cleavage. See Zhang et al., Genome Biology 201718:35; He et al., Nucleic Acids Research, 44: 9, 2016.

Template

In some embodiments, a recombination template is also provided. A recombination template may be a component of another vector as described herein, contained in a separate vector, or provided as a separate polynucleotide. In some embodiments, a recombination template is designed to serve as a template in homologous recombination, such as within or near a target sequence nicked or cleaved by a nucleic acid-targeting effector protein as a part of a nucleic acid-targeting complex. In some examples, the system comprises a recombination template. The recombination template may be inserted by homology-directed repair (HDR).

In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include a sequence that corresponds to a site on the target sequence that is cleaved by an C2c1 mediated cleavage event. In an embodiment, the template nucleic acid may include a sequence that corresponds to both a first site on the target sequence that is cleaved in a first C2c1 mediated event and a second site on the target sequence that is cleaved in a second C2c1 mediated event.

In certain embodiments, the template nucleic acid can include a sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include a sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a target gene may be used to alter the structure of a target sequence. The template sequence may be used to alter an unwanted structure, e.g., an unwanted or mutant nucleotide. The template nucleic acid may include a sequence which, when integrated, results in: decreasing the activity of a positive control element; increasing the activity of a positive control element; decreasing the activity of a negative control element; increasing the activity of a negative control element; decreasing the expression of a gene; increasing the expression of a gene; increasing resistance to a disorder or disease; increasing resistance to viral entry; correcting a mutation or altering an unwanted amino acid residue; conferring, increasing, abolishing or decreasing a biological property of a gene product, e.g., increasing the enzymatic activity of an enzyme, or increasing the ability of a gene product to interact with another molecule.

The template nucleic acid may include sequence which results in a change in sequence of 1, 2, 3, 4, 5, 6, 7, 8, 9, 10, 11, 12 or more nucleotides of the target sequence.

A template polynucleotide may be of any suitable length, such as about or more than about 10, 15, 20, 25, 50, 75, 100, 150, 200, 500, 1000, or more nucleotides in length. In an embodiment, the template nucleic acid may be 20+/−10, 30+/−10, 40+/−10, 50+/−10, 60+/−10, 70+/−10, 80+/−10, 90+/−10, 100+/−10, 110+/−10, 120+/−10, 130+/−10, 140+/−10, 150+/−10, 160+/−10, 170+/−10, 180+/−10, 190+/−10, 200+/−10, 210+/−10, or 220+/−10 nucleotides in length. In an embodiment, the template nucleic acid may be 30+/−20, 40+/−20, 50+/−20, 60+/−20, 70+/−20, 80+/−20, 90+/−20, 100+/−20, 110+/−20, 120+/−20, 130+/−20, 140+/−20, 150+/−20, 160+/−20, 170+/−20, 180+/−20, 190+/−20, 200+/−20, 210+/−20, or 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

In some embodiments, the template polynucleotide is complementary to a portion of a polynucleotide comprising the target sequence. When optimally aligned, a template polynucleotide might overlap with one or more nucleotides of a target sequences (e.g., about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the invention can be constructed using recombinant techniques (see, for example, Sambrook et al., 2001 and Ausubel et al., 1996).

In certain embodiments, a template nucleic acid for correcting a mutation may be designed for use as a single-stranded oligonucleotide. When using a single-stranded oligonucleotide, 5' and 3' homology arms may range up to about 200 base pairs (bp) in length, e.g., at least 25, 50, 75, 100, 125, 150, 175, or 200 bp in length.

Suzuki et al. describe in vivo genome editing via CRISPR/Cas9 mediated homology-independent targeted integration (2016, Nature 540:144-149).

Accordingly, when referring to the CRISPR system herein, in some aspects or embodiments, the CRISPR system comprises (i) a CRISPR protein or a polynucleotide encoding a CRISPR effector protein and (ii) one or more polynucleotides engineered to complex with the CRISPR protein to form a CRISPR complex and to complex with the target sequence.

In some embodiments, the therapeutic is for delivery (or application or administration) to a eukaryotic cell, either in vivo or ex vivo.

In some embodiments, the CRISPR protein is a nuclease directing cleavage of one or both strands at the location of the target sequence, or wherein the CRISPR protein is a nickase directing cleavage at the location of the target sequence.

In some embodiments, the CRISPR protein is a C2c1 protein complexed with a CRISPR-Cas system RNA polynucleotide sequence, wherein the polynucleotide sequence comprises: a) a guide RNA polynucleotide capable of hybridizing to a target HBV sequence; and (b) a direct repeat RNA polynucleotide.

In some embodiments, the CRISPR protein is a C2c1, and the system comprises: I. a CRISPR-Cas system RNA polynucleotide sequence, wherein the polynucleotide sequence comprises: (a) a guide RNA polynucleotide capable of hybridizing to a target sequence, and (b) a direct repeat RNA polynucleotide, and II. a polynucleotide sequence encoding the C2c1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence, and the polynucleotide sequence encoding a CRISPR protein is DNA or RNA.

The invention also provides a method of modifying a locus of interest in a cell comprising contacting the cell with any of the herein-described engineered CRISPR enzymes (e.g., engineered Cas effector module), compositions or any of the herein-described systems or vector systems, or wherein the cell comprises any of the herein-described CRISPR complexes present within the cell. In such methods, the cell may be a prokaryotic or eukaryotic cell, preferably a eukaryotic cell. In such methods, an organism may comprise the cell. In such methods, the organism may not be a human or other animal. In certain embodiments, the cell may comprise an A/T rich genome. In some embodiments, the cell genome comprises T-rich PAMs. In particular embodiments, the PAM is 5'-TTN-3' or 5'-ATTN-3'. In a particular embodiment, the PAM is 5'-TTG-3'. In a particular embodiment, the cell is a *Plasmodium falciparum* cell.

In some embodiments, the CRISPR effector protein is a C2c1 protein. C2c1 creates double strand breaks at the distal end of PAM, in contrast to cleavage at the proximal end of PAM created by Cas9 (Jinek et al., 2012; Cong et al., 2013). It is proposed that Cpf1 mutated target sequences may be susceptible to repeated cleavage by a single gRNA, hence promoting Cpf1's application in HDR mediated genome editing (Front Plant Sci. 2016 Nov. 14; 7:1683). Cpf1 and C2c1 are both Type V CRISPR-Cas proteins that share structure similarity. Unlike Cas9, which generates blunt cuts at the proximal end of PAM, Cpf1 and C2c1 generate staggered cuts at the distal end of PAM. Accordingly, in certain embodiments, the locus of interest is modified by the CRISPR-C2c1 complex via homology directed repair (HR or HDR). In certain embodiments, the locus of interest is modified by the CRISPR-C2c1 complex independent of HR. In certain embodiments, the locus of interest is modified by the CRISPR-C2c1 complex via non-homologous end joining (NHEJ).

C2c1 generates a staggered cut with a 5' overhang, in contrast to the blunt ends generated by Cas9 (Garneau et al., Nature. 2010; 468:67-71; Gasiunas et al., Proc Natl Acad Sci USA. 2012; 109:E2579-2586). This structure of the cleavage product could be particularly advantageous for facilitating non-homologous end joining (NHEJ)-based gene insertion into the mammalian genome (Maresca et al., Genome research. 2013; 23:539-546).

In certain embodiments, the locus of interest is modified by the CRISPR-C2c1 complex by inserting, or "knocking-in" a template DNA sequence. In particular embodiments, the DNA insert is designed to integrate into the genome in the proper orientation. In preferred embodiments, the locus of interest is modified by the CRISPR-C2c1 system in non-dividing cells, where genome editing via homology-directed repair (HDR) mechanisms are especially challenging (Chan et al., Nucleic acids research. 2011; 39:5955-5966). Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic LO2 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage. See Zhang et al., Genome Biology201718:35; He et al., Nucleic Acids Research, 44: 9, 2016.

In some embodiments, the CRISPR protein is a C2c1 from *Alicyclobacillus acidoterrestris* ATCC 49025 or *Bacillus thermoamylovorans* strain B4166.

The invention also provides for the nucleotide sequence encoding the effector protein being codon optimized for expression in a eukaryote or eukaryotic cell in any of the herein described methods or compositions. In an embodiment of the invention, the codon optimized effector protein is any C2c1 discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In some embodiments, the CRISPR protein further comprises one or more nuclear localization signals (NLSs) capable of driving the accumulation of the CRISPR protein to a detectible amount in the nucleus of the cell of the organism.

In certain embodiments of the invention, at least one nuclear localization signal (NLS) is attached to the nucleic acid sequences encoding the C2c1 effector proteins. In preferred embodiments, at least one or more C-terminal or N-terminal NLSs are attached (and hence nucleic acid molecule(s) coding for the C2c1 effector protein can include coding for NLS(s) so that the expressed product has the NLS(s) attached or connected). In a preferred embodiment, a C-terminal NLS is attached for optimal expression and nuclear targeting in eukaryotic cells, preferably human cells. In a preferred embodiment, the codon optimized effector protein is C2c1 and the spacer length of the guide RNA is from 15 to 35 nt. In certain embodiments, the spacer length of the guide RNA is at least 16 nucleotides, such as at least 17 nucleotides. In certain embodiments, the spacer length is from 15 to 17 nt, from 17 to 20 nt, from 20 to 24 nt, eg., 20, 21, 22, 23, or 24 nt, from 23 to 25 nt, e.g., 23, 24, or 25 nt, from 24 to 27 nt, from 27-30 nt, from 30-35 nt, or 35 nt or longer. In certain embodiments of the invention, the codon optimized effector protein is C2c1 and the direct repeat length of the guide RNA is at least 16 nucleotides. In certain embodiments, the codon optimized effector protein is C2c1 and the direct repeat length of the guide RNA is from 16 to 20 nt, e.g., 16, 17, 18, 19, or 20 nucleotides. In certain preferred embodiments, the direct repeat length of the guide RNA is 19 nucleotides.

In some embodiments, the CRISPR protein comprises one or more mutations.

In some embodiments, the CRISPR protein has one or more mutations in a catalytic domain, and wherein the protein further comprises one or more functional domains.

In some embodiments, the CRISPR system is comprised within a delivery system, optionally: a vector system comprising one or more vectors, optionally wherein the vectors comprise one or more viral vectors, optionally wherein the one or more viral vectors comprise one or more lentiviral, adenoviral or adeno-associated viral (AAV) vectors; or a particle or lipid particle, optionally wherein the CRISPR protein is complexed with the polynucleotides to form the CRISPR complex.

In some embodiments, the system, complex or protein is for use in a method of modifying an organism or a non-human organism by manipulation of a target sequence in a genomic locus of interest.

In some embodiments, the polynucleotides encoding the sequence encoding or providing the CRISPR system are delivered via liposomes, particles, cell penetrating peptides, exosomes, microvesicles, or a gene-gun. In some embodiments, a delivery system is included. In some embodiments, the delivery system comprises: a vector system comprising one or more vectors comprising the engineered polynucleotides and polynucleotide encoding the CRISPR protein, optionally wherein the vectors comprise one or more viral vectors, optionally wherein the one or more viral vectors comprise one or more lentiviral, adenoviral or adeno-associated viral (AAV) vectors; or a particle or lipid particle, containing the CRISPR system or the CRISPR complex.

In some embodiments, a recombination/repair template is provided.

The methods according to the invention as described herein comprehend inducing one or more mutations in a eukaryotic cell (in vitro, i.e., in an isolated eukaryotic cell) as herein discussed comprising delivering to the cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s) or sgRNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s) or sgRNA(s). The mutations can include the introduction, deletion, or substitution of 40, 45, 50, 75, 100, 200, 300, 400 or 500 nucleotides at each target sequence of said cell(s) via the guide(s) RNA(s) or sgRNA(s).

For minimization of toxicity and off-target effect, it may be important to control the concentration of Cas mRNA and guide RNA delivered. Optimal concentrations of Cas mRNA and guide RNA can be determined by testing different concentrations in a cellular or non-human eukaryote animal model and using deep sequencing to analyze the extent of modification at potential off-target genomic loci. Alternatively, to minimize the level of toxicity and off-target effect, Cas nickase mRNA (for example *S. pyogenes* Cas9 with the D10A mutation) can be delivered with a pair of guide RNAs targeting a site of interest. Guide sequences and strategies to minimize toxicity and off-target effects can be as in WO 2014/093622 (PCT/US2013/074667) or, via mutation as herein.

Typically, in the context of an endogenous CRISPR system, formation of a CRISPR complex (comprising a guide sequence hybridized to a target sequence and complexed with one or more Cas proteins) results in cleavage of one or both strands in or near (e.g., within 1, 2, 3, 4, 5, 6, 7, 8, 9, 10, 20, 50, or more base pairs from) the target sequence. Without wishing to be bound by theory, the tracr sequence, which may comprise or consist of all or a portion of a wild-type tracr sequence (e.g., about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence.

Engineered CRISPR-Cas Systems

In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei*, *Streptococcus pyogenes*, *Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to *Aeropyrum*, *Pyrobaculum*, *Sulfolobus*, *Archaeoglobus*, *Halocarcula*, *Methanobacterium*, *Methanococcus*, *Methanosarcina*, *Methanopyrus*, *Pyrococcus*, *Picrophilus*, *Thermoplasma*, *Corynebacterium*, *Mycobacterium*, *Streptomyces*, *Aquifex*, *Porphyromonas*, *Chlorobium*, *Thermus*, *Bacillus*, *Listeria*, *Staphylococcus*, *Clostridium*, *Thermoanaerobacter*, *Mycoplasma*, *Fusobacterium*, *Azarcus*, *Chromobacterium*, *Neisseria*, *Nitrosomonas*, *Desulfovibrio*, *Geobacter*, *Myxococcus*, *Campylobacter*, *Wolinella*, *Acinetobacter*, *Erwinia*, *Escherichia*, *Legionella*, *Methylococcus*, *Pasteurella*, *Photobacterium*, *Salmonella*, *Xanthomonas*, *Yersinia*, *Treponema*, and *Thermotoga*.

Collateral Activity

Cas12 enzymes may possess collateral activity that, in a certain environment, an activated Cas12 enzyme remains active following binding of a target sequence and continues to non-specifically cleave non-target oligonucleotides. This guide molecule-programmed collateral cleavage activity provides an ability to use Cas12b systems to detect the presence of a specific target oligonucleotide to trigger in vivo programmed cell death or in vitro non-specific RNA degradation that can serve as a readouts. (Abudayyeh et al. 2016; East-Seletsky et al, 2016).

The programmability, specificity, and collateral activity of the RNA-guided C2c1 also make it an ideal switchable nuclease for non-specific cleavage of nucleic acids. In one embodiment, a C2c1 system is engineered to provide and take advantage of collateral non-specific cleavage of nucleic acids, such as ssDNA. In another embodiment, a C2c1 system is engineered to provide and take advantage of collateral non-specific cleavage of ssDNA. Accordingly, engineered C2c1 systems provide platforms for nucleic acid detection and transcriptome manipulation, and inducing cell death. C2c1 is developed for use as a mammalian transcript knockdown and binding tool. C2c1 is capable of robust collateral cleavage of RNA and ssDNA when activated by sequence-specific targeted DNA binding.

In certain embodiments, C2c1 is provided or expressed in an in vitro system or in a cell, transiently or stably, and targeted or triggered to non-specifically cleave cellular nucleic acids. In one embodiment, C2c1 is engineered to knock down ssDNA, for example viral ssDNA. In another embodiment, C2c1 is engineered to knock down RNA. The system can be devised such that the knockdown is dependent on a target DNA present in the cell or in vitro system, or triggered by the addition of a target nucleic acid to the system or cell.

In an embodiment, the C2c1 system is engineered to non-specifically cleave RNA in a subset of cells distinguishable by the presence of an aberrant DNA sequence, for instance where cleavage of the aberrant DNA might be incomplete or ineffectual. In one non-limiting example, a DNA translocation that is present in a cancer cell and drives cell transformation is targeted. Whereas a subpopulation of cells that undergoes chromosomal DNA and repair may survive, non-specific collateral ribonuclease activity advantageously leads to cell death of potential survivors.

Collateral activity was recently leveraged for a highly sensitive and specific nucleic acid detection platform termed SHERLOCK that is useful for many clinical diagnoses (Gootenberg, J. S. et al. Nucleic acid detection with CRISPR-Cas13a/C2c2. Science 356, 438-442 (2017)).

According to the invention, engineered C2c1 systems are optimized for DNA or RNA endonuclease activity and can be expressed in mammalian cells and targeted to effectively knock down reporter molecules or transcripts in cells.

The collateral effect of engineered C2c1 with isothermal amplification provides a CRISPR-based diagnostic providing rapid DNA or RNA detection with high sensitivity and single-base mismatch specificity. The C2c1-based molecular detection platform is used to detect specific strains of virus, distinguish pathogenic bacteria, genotype human DNA, and identify cell-free tumor DNA mutations. Furthermore, reaction reagents can be lyophilized for cold-chain independence and long-term storage, and readily reconstituted on paper for field applications.

The ability to rapidly detect nucleic acids with high sensitivity and single-base specificity on a portable platform may aid in disease diagnosis and monitoring, epidemiology, and general laboratory tasks. Although methods exist for detecting nucleic acids, they have trade-offs among sensitivity, specificity, simplicity, cost, and speed.

Microbial Clustered Regularly Interspaced Short Palindromic Repeats (CRISPR) and CRISPR-associated (CRISPR-Cas) adaptive immune systems contain programmable endonucleases that can be leveraged for CRISPR-based diagnostics (CRISPR-Dx). C2c1 (also known as Cas12b), can be reprogrammed with CRISPR RNAs (crRNAs) to provide a platform for specific DNA sensing. Upon recognition of its DNA target, activated C2c1 engages in "collateral" cleavage of nearby non-targeted nucleic acids (i.e., RNA and/or ssDNA). This crRNA-programmed collateral cleavage activity allows C2c1 to detect the presence of a specific DNA in vivo by triggering programmed cell death or by nonspecific degradation of labeled RNA or ssDNA. Here is described an in vitro nucleic acid detection platform with high sensitivity based on nucleic acid amplification and C2c1-mediated collateral cleavage of a commercial reporter RNA, allowing for real-time detection of the target.

In certain example embodiments, the orthologues disclosed herein may be used alone, or in combination with other Cas12 or Cas13 orthologues in diagnostic compositions and assays. For example, the Cas12b orthologues disclosed herein may be used in multiplex assays to detect a target sequence, and then through non-specific cleavage of an oligonucleotide-based reporter, generate a detectable signal.

Reporter/Masking Constructs

As used herein, a "masking construct" refers to a molecule that can be cleaved or otherwise deactivated by an activated CRISPR system effector protein described herein. The term "masking construct" may also be referred to in the alternative as a "detection construct." Depending on the nuclease activity of the CRISPR effector protein, the masking construct may be a RNA-based masking construct or a DNA-based masking construct. The Nucleic Acid-based masking constructs comprises a nucleic acid element that is cleavable by a CRISPR effector protein. Cleavage of the nucleic acid element releases agents or produces conformational changes that allow a detectable signal to be produced. Example constructs demonstrating how the nucleic acid element may be used to prevent or mask generation of detectable signal are described below and embodiments of the invention comprise variants of the same. Prior to cleavage, or when the masking construct is in an 'active' state, the masking construct blocks the generation or detection of a positive detectable signal. It will be understood that in certain example embodiments a minimal background signal may be produced in the presence of an active masking construct. A positive detectable signal may be any signal that can be detected using optical, fluorescent, chemiluminescent, electrochemical or other detection methods known in the art. The term "positive detectable signal" is used to differentiate from other detectable signals that may be detectable in the presence of the masking construct. For example, in certain embodiments a first signal may be detected when the masking agent is present (i.e., a negative detectable signal), which then converts to a second signal (e.g., the positive detectable signal) upon detection of the target molecules and cleavage or deactivation of the masking agent by the activated CRISPR effector protein.

In certain example embodiments, the masking construct may suppress generation of a gene product. The gene product may be encoded by a reporter construct that is added to the sample. The masking construct may be an interfering RNA involved in a RNA interference pathway, such as a short hairpin RNA (shRNA) or small interfering RNA (siRNA). The masking construct may also comprise microRNA (miRNA). While present, the masking construct suppresses expression of the gene product. The gene product may be a fluorescent protein or other RNA transcript or proteins that would otherwise be detectable by a labeled probe, aptamer, or antibody but for the presence of the masking construct. Upon activation of the effector protein, the masking construct is cleaved or otherwise silenced allowing for expression and detection of the gene product as the positive detectable signal.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such purposes. In certain example embodiments, the one or more reagents are sequestered by RNA aptamers that bind the one or more reagents. The one or more reagents are released when the effector protein is activated upon detection of a target molecule and the RNA or DNA aptamers are degraded.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a RNA- or DNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent thereby allowing the labeled binding partner to bind to the immobilized reagent. Thus, the labeled binding partner remains after the wash step indicating the presence of the target molecule in the sample. In certain aspects, the masking construct that binds the immobilized reagent is a DNA or RNA aptamer. The immobilized reagent may be a protein and the labeled minding partner may be a labeled antibody. Alternatively, the immobilized reagent may be streptavidin and the labeled binding partner may be labeled biotin. The label on the binding partner used in the above embodiments may be any detectable label known in the art. In addition, other known binding partners may be used in accordance with the overall design described herein.

In certain example embodiments, the masking construct may comprise a ribozyme. Ribozymes are RNA molecules having catalytic properties. Ribozymes, both naturally and engineered, comprise or consist of RNA that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein, the reaction generating a negative control signal, or preventing generation of a positive detectable signal, is removed thereby allowing a positive detectable signal to be generated. In one example embodiment, the ribozyme may catalyze a colorimetric reaction causing a solution to appear as a first color. When the ribozyme is deactivated, the solution then turns to a second color, the second color being the detectable positive signal. An example of how ribozymes can be used to catalyze a colorimetric reaction are described in Zhao et al. "Signal amplification of glucosamine-6-phosphate based on ribozyme glmS," Biosens Bioelectron. 2014; 16:337-42, and provide an example of how such a system could be modified to work in the context of the embodiments disclosed herein. Alternatively, ribozymes, when present, can generate cleavage products of, for example, RNA transcripts. Thus, detection of a positive detectable signal may comprise detection of non-cleaved RNA transcripts that are only generated in the absence of the ribozyme.

In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more DNA or RNA aptamers to the protein. Upon activation of the effector proteins disclosed herein, the DNA or RNA aptamers are cleaved or degraded to an extent that they no longer inhibit the protein's ability to generate the detectable signal. In certain example embodiments, the aptamer is a thrombin inhibitor aptamer. In certain example embodiments the thrombin inhibitor aptamer has a sequence of GGGAACAAAGCUGAAGUACUUACCC (SEQ ID NO.439). When this aptamer is cleaved, thrombin will become active and will cleave a peptide colorimetric or fluorescent substrate. In certain example embodiments, the colorimetric substrate is para-nitroanilide (pNA) covalently linked to the peptide substrate for thrombin. Upon cleavage by thrombin, pNA is released and becomes yellow in color and easily visible to the eye. In certain example embodiments, the fluorescent substrate is 7-amino-4-methylcoumarin a blue fluorophore that can be detected using a fluorescence detector. Inhibitory aptamers may also be used for horseradish peroxidase (HRP), beta-galactosidase, or calf alkaline phosphatase (CAP) and within the general principals laid out above.

In certain embodiments, RNase or DNase activity is detected colorimetrically via cleavage of enzyme-inhibiting aptamers. One potential mode of converting DNase or RNase activity into a colorimetric signal is to couple the cleavage of a DNA or RNA aptamer with the re-activation of an enzyme that is capable of producing a colorimetric output. In the absence of RNA or DNA cleavage, the intact aptamer will bind to the enzyme target and inhibit its activity. The advantage of this readout system is that the enzyme provides an additional amplification step: once liberated from an aptamer via collateral activity (e.g., C2c1 collateral activity), the colorimetric enzyme will continue to produce colorimetric product, leading to a multiplication of signal.

In certain embodiments, an existing aptamer that inhibits an enzyme with a colorimetric readout is used. Several aptamer/enzyme pairs with colorimetric readouts exist, such as thrombin, protein C, neutrophil elastase, and subtilisin. These proteases have colorimetric substrates based upon pNA and are commercially available. In certain embodiments, a novel aptamer targeting a common colorimetric enzyme is used. Common and robust enzymes, such as beta-galactosidase, horseradish peroxidase, or calf intestinal alkaline phosphatase, could be targeted by engineered aptamers designed by selection strategies such as SELEX. Such strategies allow for quick selection of aptamers with nanomolar binding efficiencies and could be used for the development of additional enzyme/aptamer pairs for colorimetric readout.

In certain embodiments, RNase or DNase activity is detected colorimetrically via cleavage of RNA-tethered inhibitors. Many common colorimetric enzymes have competitive, reversible inhibitors: for example, beta-galactosidase can be inhibited by galactose. Many of these inhibitors are weak, but their effect can be increased by increases in local concentration. By linking local concentration of inhibitors to DNase and/or RNase activity, colorimetric enzyme and inhibitor pairs can be engineered into DNase and RNase sensors. The colorimetric DNase or RNase sensor based upon small-molecule inhibitors involves three components: the colorimetric enzyme, the inhibitor, and a bridging RNA or DNA that is covalently linked to both the inhibitor and enzyme, tethering the inhibitor to the enzyme. In the uncleaved configuration, the enzyme is inhibited by the increased local concentration of the small molecule; when the DNA or RNA is cleaved (e.g., by Cas13 or Cas12 collateral cleavage), the inhibitor will be released, and the colorimetric enzyme will be activated.

In certain embodiments, RNase or DNase activity is detected colorimetrically via formation and/or activation of G-quadruplexes. G quadraplexes in DNA can complex with heme (iron (III)-protoporphyrin IX) to form a DNAzyme with peroxidase activity. When supplied with a peroxidase substrate (e.g., ABTS: (2,2'-Azinobis [3-ethylbenzothiazoline-6-sulfonic acid]-diammonium salt)), the G-quadraplex-heme complex in the presence of hydrogen peroxide causes oxidation of the substrate, which then forms a green color in solution. An example G-quadraplex forming DNA sequence is: GGGTAGGGCGGGTTGGGA (SEQ ID NO:440). By hybridizing an additional DNA or RNA sequence, referred to herein as a "staple," to this DNA aptamer, formation of the G-quadraplex structure will be limited. Upon collateral activation, the staple will be cleaved allowing the G quadraplex to form and heme to bind. This strategy is particularly appealing because color formation is enzymatic, meaning there is additional amplification beyond collateral activation.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a DNA- or RNA-based aptamer that can be cleaved by the activated effector protein upon detection of a target molecule.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. At least a portion of the bridge molecule comprises RNA or DNA. Upon activation of the effector proteins disclosed herein, the RNA or DNA portion of the bridge molecule is cleaved allowing the detection agent to disperse and resulting in the corresponding change in color. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the A13+, Ru3+, Zn2+, Fe3+, Ni2+ and Ca2+ ions.

When the RNA or DNA bridge is cut by the activated CRISPR effector, the aforementioned color shift is observed. In certain example embodiments the particles are colloidal metals. In certain other example embodiments, the colloidal metal is a colloidal gold. In certain example embodiments, the colloidal nanoparticles are 15 nm gold nanoparticles (AuNPs). Due to the unique surface properties of colloidal gold nanoparticles, maximal absorbance is observed at 520 nm when fully dispersed in solution and appear red in color to the naked eye. Upon aggregation of AuNPs, they exhibit a red-shift in maximal absorbance and appear darker in color, eventually precipitating from solution as a dark purple aggregate. In certain example embodiments the nanoparticles are modified to include DNA linkers extending from the surface of the nanoparticle. Individual particles are linked together by single-stranded RNA (ssRNA) or single-stranded DNA bridges that hybridize on each end to at least a portion of the DNA linkers. Thus, the nanoparticles will form a web of linked particles and aggregate, appearing as a dark precipitate. Upon activation of the CRISPR effectors disclosed herein, the ssRNA or ssDNA bridge will be cleaved, releasing the AuNPs from the linked mesh and producing a visible red color. Example DNA linkers and bridge sequences are listed below. Thiol linkers on the end of the DNA linkers may be used for surface conjugation to the AuNPs. Other forms of conjugation may be used. In certain example embodiments, two populations of AuNPs may be generated, one for each DNA linker. This will help facilitate proper binding of the ssRNA bridge with proper orientation. In certain example embodiments, a first DNA linker is conjugated by the 3' end while a second DNA linker is conjugated by the 5' end.

TABLE 5

| DNA linkers and bridge sequences | |
|---|---|
| C2c2 colorimetric DNA1 | TTATAACTATTCCTAAAAAA AAAAA/3ThioMC3-D/ (SEQ ID NO: 441) |
| C2c2 colorimetric DNA2 | /5ThioMC6-D/AAAAAAAA AACTCCCCTAATAACAAT (SEQ ID NO: 442) |
| C2c2 colorimetric bridge | GGGUAGGAAUAGUUAUAAUU UCCCUUUCCCAUUGUU AUUAGGGAG (SEQ ID NO: 443) |

In certain other example embodiments, the masking construct may comprise an RNA or DNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA or DNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA or DNA oligonucleotide is cleaved thereby severing the proximity between the fluorophore and quencher needed to maintain the contact quenching effect. Accordingly, detection of the fluorophore may be used to determine the presence of a target molecule in a sample.

In certain other example embodiments, the masking construct may comprise one or more RNA oligonucleotides to which are attached one or more metal nanoparticles, such as gold nanoparticles. In some embodiments, the masking construct comprises a plurality of metal nanoparticles crosslinked by a plurality of RNA or DNA oligonucleotides forming a closed loop. In one embodiment, the masking construct comprises three gold nanoparticles crosslinked by three RNA or DNA oligonucleotides forming a closed loop. In some embodiments, the cleavage of the RNA or DNA oligonucleotides by the CRISPR effector protein leads to a detectable signal produced by the metal nanoparticles.

In certain other example embodiments, the masking construct may comprise one or more RNA or DNA oligonucleotides to which are attached one or more quantum dots. In some embodiments, the cleavage of the RNA or DNA oligonucleotides by the CRISPR effector protein leads to a detectable signal produced by the quantum dots.

In one example embodiment, the masking construct may comprise a quantum dot. The quantum dot may have multiple linker molecules attached to the surface. At least a portion of the linker molecule comprises RNA or DNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art. Upon activation of the effector proteins disclosed herein, the RNA or DNA portion of the linker molecule is cleaved thereby eliminating the proximity between the quantum dot and one or more quenchers needed to maintain the quenching effect. In certain example embodiments, the quantum dot is streptavidin conjugated. RNA or DNA are attached via biotin linkers and recruit quenching molecules with the sequences/ 5Biosg/ UCUCGUACGUUC/3IAbRQSp/ (SEQ ID NO. 444) or /5Biosg/UCUCGUACGUUCUCUCGUACGUUC/ 3IAbRQSp/ (SEQ ID NO. 445), where /5Biosg/ is a biotin tag and /31AbRQSp/ is an Iowa black quencher. Upon cleavage, by the activated effectors disclosed herein, the quantum dot will fluoresce visibly.

In a similar fashion, fluorescence energy transfer (FRET) may be used to generate a detectable positive signal. FRET is a non-radiative process by which a photon from an energetically excited fluorophore (i.e., "donor fluorophore") raises the energy state of an electron in another molecule (i.e., "the acceptor") to higher vibrational levels of the excited singlet state. The donor fluorophore returns to the ground state without emitting a fluoresce characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule, the absorbed energy is loss as heat. Thus, in the context of the embodiments disclosed herein, the fluorophore/quencher pair is replaced with a donor fluorophore/ acceptor pair attached to the oligonucleotide molecule. When intact, the masking construct generates a first signal (negative detectable signal) as detected by the fluorescence or heat emitted from the acceptor. Upon activation of the effector proteins disclosed herein, the RNA oligonucleotide is cleaved and FRET is disrupted such that fluorescence of the donor fluorophore is now detected (positive detectable signal).

In certain example embodiments, the masking construct comprises the use of intercalating dyes which change their absorbance in response to cleavage of long RNAs or DNAs to short nucleotides. Several such dyes exist. For example, pyronine-Y will complex with RNA and form a complex that has an absorbance at 572 nm. Cleavage of the RNA results in loss of absorbance and a color change. Methylene blue may be used in a similar fashion, with changes in absorbance at 688 nm upon RNA cleavage. Accordingly, in certain example embodiments, the masking construct comprises a RNA and intercalating dye complex that changes absorbance upon the cleavage of RNA by the effector proteins disclosed herein.

In certain example embodiments, the masking construct may comprise an initiator for an HCR reaction. See e.g., Dirks and Pierce. PNAS 101, 15275-15728 (2004). HCR reactions utilize the potential energy in two hairpin species. When a single-stranded initiator having a portion of complementary to a corresponding region on one of the hairpins is released into the previously stable mixture, it opens a hairpin of one species. This process, in turn, exposes a single-stranded region that opens a hairpin of the other species. This process, in turn, exposes a single stranded region identical to the original initiator. The resulting chain reaction may lead to the formation of a nicked double helix that grows until the hairpin supply is exhausted. Detection of the resulting products may be done on a gel or colorimetrically. Example colorimetric detection methods include, for example, those disclosed in Lu et al. "Ultra-sensitive colorimetric assay system based on the hybridization chain reaction-triggered enzyme cascade amplification ACS Appl Mater Interfaces, 2017, 9(1):167-175, Wang et al. "An enzyme-free colorimetric assay using hybridization chain reaction amplification and split aptamers" Analyst 2015, 150, 7657-7662, and Song et al. "Non covalent fluorescent labeling of hairpin DNA probe coupled with hybridization chain reaction for sensitive DNA detection." Applied Spectroscopy, 70(4): 686-694 (2016).

In certain example embodiments, the masking construct may comprise an HCR initiator sequence and a cleavable structural element, such as a loop or hairpin, that prevents the initiator from initiating the HCR reaction. Upon cleavage of the structure element by an activated CRISPR effector protein, the initiator is then released to trigger the HCR reaction, detection thereof indicating the presence of one or more targets in the sample. In certain example embodiments, the masking construct comprises a hairpin with a RNA loop. When an activated CRISRP effector protein cuts the RNA loop, the initiator can be released to trigger the HCR reaction.

Amplification of Target Oligonucleotides

In certain example embodiments, target RNAs and/or DNAs may be amplified prior to activating the CRISPR effector protein. Any suitable RNA or DNA amplification technique may be used. In certain example embodiments, the RNA or DNA amplification is an isothermal amplification. In certain example embodiments, the isothermal amplification may be nucleic-acid sequenced-based amplification (NASBA), recombinase polymerase amplification (RPA), loop-mediated isothermal amplification (LAMP), strand displacement amplification (SDA), helicase-dependent amplification (HDA), or nicking enzyme amplification reaction (NEAR). In certain example embodiments, non-isothermal amplification methods may be used which include, but are not limited to, PCR, multiple displacement amplification (MDA), rolling circle amplification (RCA), ligase chain reaction (LCR), or ramification amplification method (RAM).

In certain example embodiments, the RNA or DNA amplification is NASBA, which is initiated with reverse transcription of target RNA by a sequence-specific reverse primer to create a RNA/DNA duplex. RNase H is then used to degrade the RNA template, allowing a forward primer containing a promoter, such as the T7 promoter, to bind and initiate elongation of the complementary strand, generating a double-stranded DNA product. The RNA polymerase promoter-mediated transcription of the DNA template then creates copies of the target RNA sequence. Importantly, each of the new target RNAs can be detected by the guide RNAs thus further enhancing the sensitivity of the assay. Binding of the target RNAs by the guide RNAs then leads to activation of the CRISPR effector protein and the methods proceed as outlined above. The NASBA reaction has the additional advantage of being able to proceed under moderate isothermal conditions, for example at approximately 41° C., making it suitable for systems and devices deployed for early and direct detection in the field and far from clinical laboratories.

In certain other example embodiments, a recombinase polymerase amplification (RPA) reaction may be used to amplify the target nucleic acids. RPA reactions employ recombinases which are capable of pairing sequence-specific primers with homologous sequence in duplex DNA. If target DNA is present, DNA amplification is initiated and no other sample manipulation such as thermal cycling or chemical melting is required. The entire RPA amplification system is stable as a dried formulation and can be transported safely without refrigeration. RPA reactions may also be carried out at isothermal temperatures with an optimum reaction temperature of 37-42° C. The sequence specific primers are designed to amplify a sequence comprising the target nucleic acid sequence to be detected. In certain example embodiments, a RNA polymerase promoter, such as a T7 promoter, is added to one of the primers. This results in an amplified double-stranded DNA product comprising the target sequence and a RNA polymerase promoter. After, or during, the RPA reaction, a RNA polymerase is added that will produce RNA from the double-stranded DNA templates. The amplified target RNA can then in turn be detected by the CRISPR effector system. In this way, target DNA can be detected using the embodiments disclosed herein. RPA reactions can also be used to amplify target RNA. The target RNA is first converted to cDNA using a reverse transcriptase, followed by second strand DNA synthesis, at which point the RPA reaction proceeds as outlined above.

Figure 5:
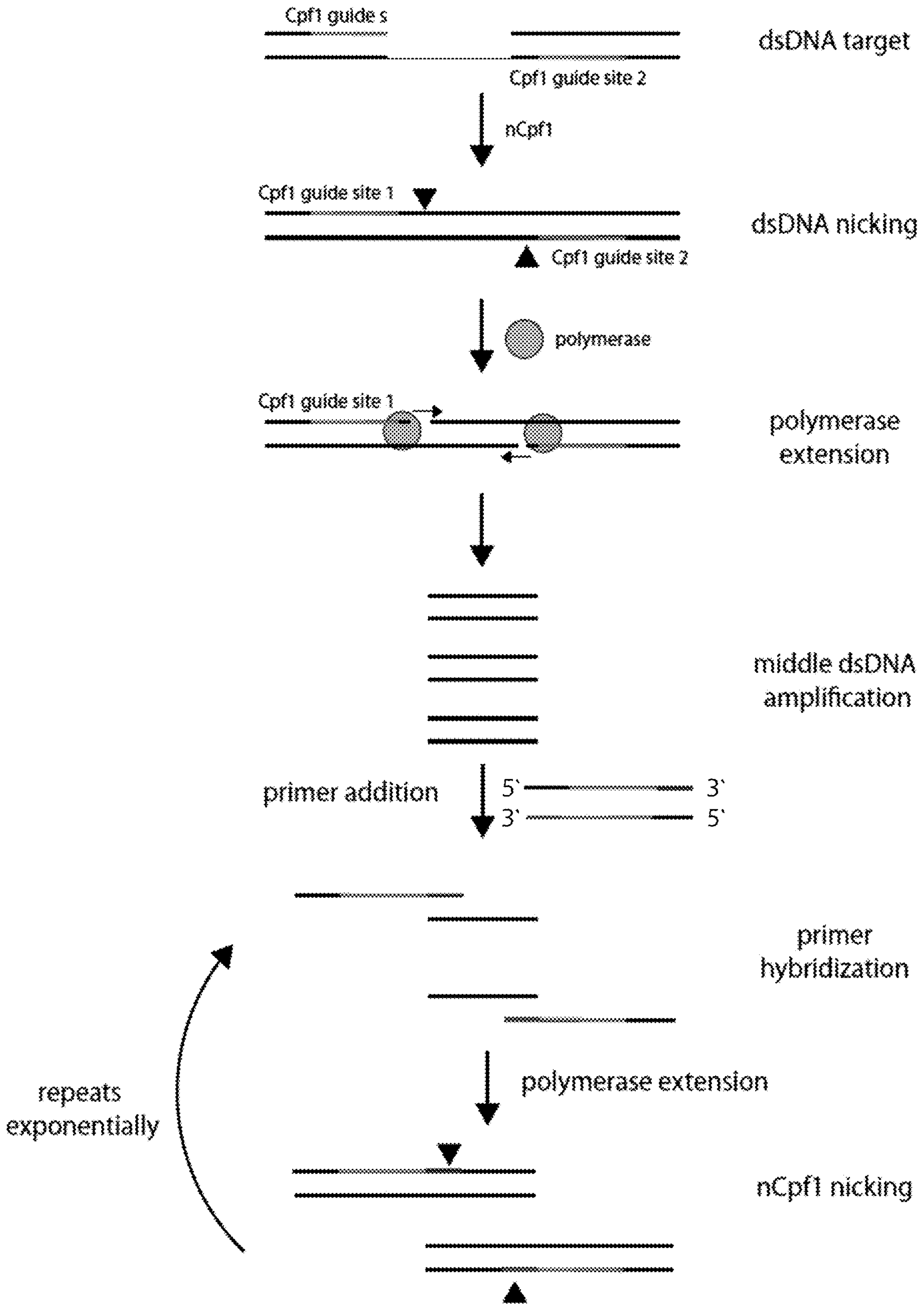
FIG. 5 depicts sequence specific nickase amplification using Cpf1 nickase.

In an embodiment of the invention, the nicking enzyme is a CRISPR protein. Accordingly, the introduction of nicks into dsDNA can be programmable and sequence-specific. FIG. 5 depicts an embodiment of the invention, which starts with two guides designed to target opposite strands of a dsDNA target. According to the invention, the nickase can be C2c1 or C2c1 used in concert with Cpf1, C° C. In other embodiments, the temperature of the isothermal amplification may be chosen by selecting a polymerase (e.g., Bsu, Bst, Phi29, klenow fragment etc.) operable at a different temperature.

Thus, where nicking isothermal amplification techniques use nicking enzymes with fixed sequence preference (e.g., in nicking enzyme amplification reaction or NEAR), which requires denaturing of the original dsDNA target to allow annealing and extension of primers that add the nicking substrate to the ends of the target, use of a CRISPR nickase wherein the nicking sites can be programmed via guide RNAs means that no denaturing step is necessary, enabling the entire reaction to be truly isothermal. This also simplifies the reaction because these primers that add the nicking substrate are different than the primers that are used later in the reaction, meaning that NEAR requires two primer sets (i.e., 4 primers) while C2c1 nicking amplification only requires one primer set (i.e., two primers). This makes nicking C2c1 amplification much simpler and easier to operate without complicated instrumentation to perform the denaturation and then cooling to the isothermal temperature.

Accordingly, in certain example embodiments, the systems disclosed herein may include amplification reagents. Different components or reagents useful for amplification of nucleic acids are described herein. For example, an amplification reagent as described herein may include a buffer, such as a Tris buffer. A Tris buffer may be used at any concentration appropriate for the desired application or use, for example including, but not limited to, a concentration of 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 25 mM, 50 mM, 75 mM, 1 M, or the like. One of skill in the art will be able to determine an appropriate concentration of a buffer such as Tris for use with the present invention.

A salt, such as magnesium chloride (MgCl2), potassium chloride (KCl), or sodium chloride (NaCl), may be included in an amplification reaction, such as PCR, in order to improve the amplification of nucleic acid fragments. Although the salt concentration will depend on the particular reaction and application, in some embodiments, nucleic acid fragments of a particular size may produce optimum results at particular salt concentrations. Larger products may require altered salt concentrations, typically lower salt, in order to produce desired results, while amplification of smaller products may produce better results at higher salt concentrations. One of skill in the art will understand that the presence and/or concentration of a salt, along with alteration of salt concentrations, may alter the stringency of a biological or chemical reaction, and therefore any salt may be used that provides the appropriate conditions for a reaction of the present invention and as described herein.

Other components of a biological or chemical reaction may include a cell lysis component in order to break open or lyse a cell for analysis of the materials therein. A cell lysis component may include, but is not limited to, a detergent, a salt as described above, such as NaCl, KCl, ammonium sulfate [(NH4)2SO4], or others. Detergents that may be appropriate for the invention may include Triton X-100, sodium dodecyl sulfate (SDS), CHAPS (3-[(3-cholamidopropyl)dimethylammonio]-1-propanesulfonate), ethyl trimethyl ammonium bromide, nonyl phenoxypolyethoxylethanol (NP-40). Concentrations of detergents may depend on the particular application, and may be specific to the reaction in some cases. Amplification reactions may include dNTPs and nucleic acid primers used at any concentration appropriate for the invention, such as including, but not limited to, a concentration of 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, 950 nM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 150 mM, 200 mM, 250 mM, 300 mM, 350 mM, 400 mM, 450 mM, 500 mM, or the like. Likewise, a polymerase useful in accordance with the invention may be any specific or general polymerase known in the art and useful with the invention, including Taq polymerase, Q5 polymerase, or the like.

In some embodiments, amplification reagents as described herein may be appropriate for use in hot-start amplification. Hot-start amplification may be beneficial in some embodiments to reduce or eliminate dimerization of adaptor molecules or oligos, or to otherwise prevent unwanted amplification products or artifacts and obtain optimum amplification of the desired product. Many components described herein for use in amplification may also be used in hot-start amplification. In some embodiments, reagents or components appropriate for use with hot-start amplification may be used in place of one or more of the composition components as appropriate. For example, a polymerase or other reagent may be used that exhibits a desired activity at a particular temperature or other reaction condition. In some embodiments, reagents may be used that are designed or optimized for use in hot-start amplification, for example, a polymerase may be activated after transposition or after reaching a particular temperature. Such polymerases may be antibody-based or aptamer-based. Polymerases as described herein are known in the art. Examples of such reagents may include, but are not limited to, hot-start polymerases, hot-start dNTPs, and photo-caged dNTPs. Such reagents are known and available in the art. One of skill in the art will be able to determine the optimum temperatures as appropriate for individual reagents.

Amplification of nucleic acids may be performed using specific thermal cycle machinery or equipment, and may be performed in single reactions or in bulk, such that any desired number of reactions may be performed simultaneously. In some embodiments, amplification may be performed using microfluidic or robotic devices, or may be performed using manual alteration in temperatures to achieve the desired amplification. In some embodiments, optimization may be performed to obtain the optimum reaction conditions for the particular application or materials. One of skill in the art will understand and be able to optimize reaction conditions to obtain sufficient amplification.

In certain embodiments, detection of DNA with the methods or systems of the invention requires transcription of the (amplified) DNA into RNA prior to detection.

It will be evident that detection methods of the invention can involve nucleic acid amplification and detection procedures in various combinations. The nucleic acid to be detected can be any naturally occurring or synthetic nucleic acid, including, but not limited to, DNA and RNA, which may be amplified by any suitable method to provide an intermediate product that can be detected. Detection of the intermediate product can be by any suitable method including, but not limited to, binding and activation of a CRISPR protein which produces a detectable signal moiety by direct or collateral activity.

The systems, devices, and methods disclosed herein may also be adapted for detection of polypeptides (or other molecules) in addition to detection of nucleic acids, via incorporation of a specifically configured polypeptide detection aptamer. The polypeptide detection aptamers are distinct from the masking construct aptamers discussed above. First, the aptamers are designed to specifically bind to one or more target molecules. In one example embodiment, the target molecule is a target polypeptide. In another example embodiment, the target molecule is a target chemical compound, such as a target therapeutic molecule. Methods for designing and selecting aptamers with specificity for a given target, such as SELEX, are known in the art. In addition to specificity to a given target, the aptamers are further designed to incorporate a polymerase promoter binding site. In certain example embodiments, the polymerase promoter is a T7 promoter. Prior to binding the aptamer binding to a target, the polymerase site is not accessible or otherwise recognizable to a polymerase. However, the aptamer is configured so that upon binding of a target the structure of the aptamer undergoes a conformational change such that the polymerase promoter is then exposed. An aptamer sequence downstream of the polymerase promoter acts as a template for generation of a trigger oligonucleotide by a RNA or DNA polymerase. Thus, the template portion of the aptamer may further incorporate a barcode or other identifying sequence that identifies a given aptamer and its target. Guide RNAs as described above may then be designed to recognize these specific trigger oligonucleotide sequences. Binding of the guide RNAs to the trigger oligonucleotides activates the CRISPR effector proteins which proceeds to deactivate the masking constructs and generate a positive detectable signal as described previously.

Accordingly, in certain example embodiments, the methods disclosed herein comprise the additional step of distributing a sample or set of samples into a set of individual discrete volumes, each individual discrete volume comprising peptide detection aptamers, a CRISPR effector protein, one or more guide RNAs, a masking construct, and incubating the sample or set of samples under conditions sufficient to allow binding of the detection aptamers to the one or more target molecules, wherein binding of the aptamer to a corresponding target results in exposure of the polymerase promoter binding site such that synthesis of a trigger oligonucleotide is initiated by the binding of a RNA polymerase to the RNA polymerase promoter binding site.

In another example embodiment, binding of the aptamer may expose a primer binding site upon binding of the aptamer to a target polypeptide. For example, the aptamer may expose a RPA primer binding site. Thus, the addition or inclusion of the primer will then feed into an amplification reaction, such as the RPA reaction outlined above.

In certain example embodiments, the aptamer may be a conformation-switching aptamer, which upon binding to the target of interest may change secondary structure and expose new regions of single-stranded DNA. In certain example embodiments, these new-regions of single-stranded DNA may be used as substrates for ligation, extending the aptamers and creating longer ssDNA molecules which can be specifically detected using the embodiments disclosed herein. The aptamer design could be further combined with ternary complexes for detection of low-epitope targets, such as glucose (Yang et al. 2015: pubs.acs.org/doi/abs/10.1021/acs.analchem.5b01634). Example conformation shifting aptamers and corresponding guide RNAs (crRNAs) are shown below.

| | |
|---|---|
| Thrombin aptamer | tgtggttggt gtggttggtt catggtcata ttggtttttt tttttttttc caaccacagtctctgt (SEQ ID NO: 446) |
| Thrombin ligation probe | ggttggtagt ctcgaattgc tctctttcac tggcc (SEQ ID NO: 447) |
| Thrombin RPA forward 1 primer | gaaattaata cgactcacta tagggggttg gttcatggtc atattggt (SEQ ID NO: 448) |
| Thrombin RPA forward 2 primer | gaaattaata cgactcacta tagggggttg gtgtggttgg ttcatggtca tattggt (SEQ ID NO: 449) |
| Thrombin RPA reverse 1 primer | ggccagtgaa agagagcaat tcgagactac c (SEQ ID NO: 450) |
| Thrombin crRNA 1 | gauuuagacu accccaaaaa cgaaggggac uaaaacccag ugaaagagag caauucgaga cuac (SEQ ID NO: 451) |
| Thrombin crRNA 2 | gauuuagacu accccaaaaa cgaaggggac uaaaacaaag agagcaauuc gagacuacca acca (SEQ ID NO: 452) |
| Thrombin crRNA 3 | gauuuagacu accccaaaaa cgaaggggac uaaaacagac uaccaaccac agagacugug guug (SEQ ID NO: 453) |
| PTK7 full length amplicon control | gttagatcgc aagcatatca ttgcgcttgc gatctaactg ctgcgccgcc gggaaaatac tgtacggtta gatcgcatag tctcgaattg ctctctttca ctggcc (SEQ ID NO: 454) |
| PTK7 aptamer | gttagatcgc aagcatatca ttgcgcttgc gatctaactg ctgcgccgcc gggaaaatac tgtacggtta g (SEQ ID NO: 455) |
| PTK7 ligation probe | atcgcatagt ctcgaattgc tctctttcac tggcc (SEQ ID NO: 456) |

-continued

| | |
|---|---|
| PTK7 RPA forward 1 primer | gaaattaata cgactcacta tagggatcgc aagcatatca ttgcgcttgc (SEQ ID NO: 457) |
| PTK7 RPA reverse 1 primer | ggccagtgaa agagagcaat tcgagactat g (SEQ ID NO: 458) |
| PTK7 crRNA 1 | gauuuagacu accccaaaaa cgaaggggac uaaaacccag ugaaagagag caauucgaga cuau (SEQ ID NO: 459) |
| PTK7 crRNA 2 | gauuuagacu accccaaaaa cgaaggggac uaaaacagag caauucgaga cuaugcgauc uaac (SEQ ID NO: 460) |
| PTK7 crRNA 3 | gauuuagacu accccaaaaa cgaaggggac uaaaacacua ugcgaucuaa ccguacagua uuuu (SEQ ID NO: 461) |

General Comments on Methods of Use of the CRISPR System

In particular embodiments, the methods described herein may involve targeting one or more polynucleotide targets of interest. The polynucleotide targets of interest may be targets which are relevant to a specific disease or the treatment thereof, relevant for the generation of a given trait of interest or relevant for the production of a molecule of interest. When referring to the targeting of a "polynucleotide target," this may include targeting one or more of a coding regions, an intron, a promoter and any other 5' or 3' regulatory regions such as termination regions, ribosome binding sites, enhancers, silencers etc. The gene may encode any protein or RNA of interest. Accordingly, the target may be a coding region which can be transcribed into mRNA, tRNA or rRNA, but also recognition sites for proteins involved in replication, transcription and regulation thereof.

In particular embodiments, the methods described herein may involve targeting one or more genes of interest, wherein at least one gene of interest encodes a long noncoding RNA (lncRNA). While lncRNAs have been found to be critical for cellular functioning. As the lncRNAs that are essential have been found to differ for each cell type (C. P. Fulco et al., 2016, Science, doi:10.1126/science.aag2445; N. E. Sanjana et al., 2016, Science, doi:10.1126/science.aaf8325), the methods provided herein may involve the step of determining the lncRNA that is relevant for cellular function for the cell of interest.

In an exemplary method for modifying a target polynucleotide by integrating an exogenous polynucleotide template, a double stranded break is introduced into the genome sequence by the CRISPR complex, the break is repaired via homologous recombination with an exogenous polynucleotide template such that the template is integrated into the genome. The presence of a double-stranded break facilitates integration of the template.

In other embodiments, this invention provides a method of modifying expression of a polynucleotide in an eukaryotic cell. The method comprises increasing or decreasing expression of a target polynucleotide by using a CRISPR complex that binds to the polynucleotide.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include a promoter, a transcription terminator, and an enhancer. The inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knockout" of the target sequence.

Also provided herein are methods of functional genomics which involve identifying cellular interactions by introducing multiple combinatorial perturbations and correlating observed genomic, genetic, proteomic, epigenetic and/or phenotypic effects with the perturbation detected in single cells, also referred to as "perturb-seq". In one embodiment, these methods combine single-cell RNA sequencing (RNA-seq) and clustered regularly interspaced short palindromic repeats (CRISPR)-based perturbations (Dixit et al. 2016, Cell 167, 1853-1866; Adamson et al. 2016, Cell 167, 1867-1882). Generally, these methods involve introducing a number of combinatorial perturbations to a plurality of cells in a population of cells, wherein each cell in the plurality of the cells receives at least 1 perturbation detecting genomic, genetic, proteomic, epigenetic and/or phenotypic differences in single cells compared to one or more cells that did not receive any perturbation, and detecting the perturbation(s) in single cells; and determining measured differences relevant to the perturbations by applying a model accounting for co-variates to the measured differences, whereby intercellular and/or intracellular networks or circuits are inferred. More particularly, the single cell sequencing comprises cell barcodes, whereby the cell-of-origin of each RNA is recorded. More particularly, the single cell sequencing comprises unique molecular identifiers (UMI), whereby the capture rate of the measured signals, such as transcript copy number or probe binding events, in a single cell is determined.

These methods can be used for combinatorial probing of cellular circuits, for dissecting cellular circuitry, for delineating molecular pathways, and/or for identifying relevant targets for therapeutics development. More particularly, these methods may be used to identify groups of cells based on their molecular profiling. Similarities in gene-expression profiles between organic (e.g., disease) and induced (e.g., by small molecule) states may identify clinically-effective therapies.

Accordingly, in particular embodiments, therapeutic methods provided herein comprise, determining, for a population of cells isolated from a subject, optimal therapeutic target and/or therapeutic, using perturb-seq as described above.

In particular embodiments, pertub-seq methods as referred to herein elsewhere are used to determine, in an isolated cell or cell line, cellular circuits which may affect production of a molecule of interest.

Additional CRISPR-Cas Development and Use Considerations

The present invention may be further illustrated and extended based on aspects of CRISPR-Cas9 development and use as set forth in the following articles and particularly as relates to delivery of a CRISPR protein complex and uses of an RNA guided endonuclease in cells and organisms:

- Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121): 819-23 (2013);
- RNA-guided editing of bacterial genomes using CRISPR-Cas systems. Jiang W., Bikard D., Cox D., Zhang F, Marraffini L A. Nat Biotechnol March; 31(3):233-9 (2013);
- One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4):910-8 (2013);
- Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463):472-6. doi: 10.1038/Nature12466. Epub 2013 Aug. 23 (2013);
- Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);
- DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);
- Genome engineering using the CRISPR-Cas9 system. Ran, F A., Hsu, P D., Wright, J., Agarwala, V., Scott, D A., Zhang, F. Nature Protocols November; 8(11):2281-308 (2013-B);
- Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print];
- Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);
- Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);
- CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure™, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);
- Development and Applications of CRISPR-Cas9 for Genome Engineering, Hsu P D, Lander E S, Zhang F., Cell. June 5; 157(6):1262-78 (2014);
- Genetic screens in human cells using the CRISPR/Cas9 system, Wang T, Wei J J, Sabatini D M, Lander E S., Science. January 3; 343(6166): 80-84. doi:10.1126/science.1246981 (2014);
- Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);
- In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);
- Genome-scale transcriptional activation by an engineered CRISPR-Cas9 complex, Konermann S, Brigham M D, Trevino A E, Joung J, Abudayyeh 00, Barcena C, Hsu P D, Habib N, Gootenberg J S, Nishimasu H, Nureki O, Zhang F., Nature. January 29; 517(7536):583-8 (2015);
- A split-Cas9 architecture for inducible genome editing and transcription modulation, Zetsche B, Volz S E, Zhang F., (published online 2 Feb. 2015) Nat Biotechnol. February; 33(2):139-42 (2015);
- Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse);
- In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520 (7546):186-91 (2015);
- Shalem et al., “High-throughput functional genomics using CRISPR-Cas9,” Nature Reviews Genetics 16, 299-311 (May 2015);
- Xu et al., “Sequence determinants of improved CRISPR sgRNA design,” Genome Research 25, 1147-1157 (August 2015);
- Parnas et al., “A Genome-wide CRISPR Screen in Primary Immune Cells to Dissect Regulatory Networks,” Cell 162, 675-686 (Jul. 30, 2015);
- Ramanan et al., CRISPR/Cas9 cleavage of viral DNA efficiently suppresses hepatitis B virus,” Scientific Reports 5:10833. doi: 10.1038/srep10833 (Jun. 2, 2015);
- Nishimasu et al., Crystal Structure of *Staphylococcus aureus* Cas9,” Cell 162, 1113-1126 (Aug. 27, 2015);
- BCL11A enhancer dissection by Cas9-mediated in situ saturating mutagenesis, Canver et al., Nature 527 (7577):192-7 (Nov. 12, 2015) doi: 10.1038/nature15521. Epub 2015 Sep. 16;
- Cpf1 Is a Single RNA-Guided Endonuclease of a Class 2 CRISPR-Cas System, Zetsche et al., Cell 163, 759-71 (Sep. 25, 2015);
- Discovery and Functional Characterization of Diverse Class 2 CRISPR-Cas Systems, Shmakov et al., Molecular Cell, 60(3), 385-397 doi: 10.1016/j.molcel.2015.10.008 Epub Oct. 22, 2015;
- Rationally engineered Cas9 nucleases with improved specificity, Slaymaker et al., Science 2016 Jan. 1 351 (6268): 84-88 doi: 10.1126/science.aad5227. Epub 2015 Dec. 1. [Epub ahead of print]; and Gao et al, "Engineered Cpf1 Enzymes with Altered PAM Specificities," bioRxiv 091611; doi: dx.doi.org/10.1101/091611 (Dec. 4, 2016);

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli,* 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors.

Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and gRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors we developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cpf1, a class 2 CRISPR nuclease from *Francisella novicida* U112 having features distinct from Cas9. Cpf1 is a single RNA-guided endonuclease lacking tracrRNA, utilizes a T-rich protospacer-adjacent motif, and cleaves DNA via a staggered DNA double-stranded break.

Shmakov et al. (2015) reported three distinct Class 2 CRISPR-Cas systems. Two system CRISPR enzymes (C2c1 and C2c3) contain RuvC-like endonuclease domains distantly related to Cpf1. Unlike Cpf1, C2c1 depends on both crRNA and tracrRNA for DNA cleavage. The third enzyme (C2c2) contains two predicted HEPN RNase domains and is tracrRNA independent.

Slaymaker et al (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

The methods and tools provided herein are exemplified for C2c1, a type II nuclease that does not make use of tracrRNA. Orthologs of C2c1 have been identified in different bacterial species as described herein. Further type II nucleases with similar properties can be identified using methods described in the art (Shmakov et al. 2015, 60:385-397; Abudayeh et al. 2016, Science, 5; 353(6299)). In particular embodiments, such methods for identifying novel CRISPR effector proteins may comprise the steps of: selecting sequences from the database, encoding a seed which identifies the presence of a CRISPR Cas locus, and identifying loci located within 10 kb of the seed comprising Open Reading Frames (ORFs) in the selected sequences, and selecting therefrom loci comprising ORFs of which only a single ORF encodes a novel CRISPR effector having greater than 700 amino acids and no more than 90% homology to a known CRISPR effector. In particular embodiments, the seed is a protein that is common to the CRISPR-Cas system, such as Cas1. In further embodiments, the CRISPR array is used as a seed to identify new effector proteins.

Preassembled recombinant CRISPR-C2c1 complexes comprising C2c1 and crRNA may be transfected, for example by electroporation, resulting in high mutation rates and absence of detectable off-target mutations. Hur, J. K. et al, Targeted mutagenesis in mice by electroporation of Cpf1 ribonucleoproteins, Nat Biotechnol. 2016 Jun. 6. doi: 10.1038/nbt.3596. [Epub ahead of print]. An efficient multiplexed system employing Cpf1 has been demonstrated in *Drosophila* employing gRNAs processed from an array containing inventing tRNAs. Port, F. et al, Expansion of the CRISPR toolbox in an animal with tRNA-flanked Cas9 and Cpf1 gRNAs. doi: dx.doi.org/10.1101/046417. Cpf1 and C2c1 are both Type V CRISPR Cas proteins that share structure similarity. Like C2c1, Cpf1 creates staggered double strand breaks at the distal end of PAM (in contrast to Cas9, which creates blunt cut at the proximal end of PAM). Accordingly, similar multiplexed system employing C2c1 is envisaged.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,697,359, 8,771,945, 8,795,965, 8,865,406, 8,871,445, 8,889,356, 8,889,418, 8,895,308, 8,906,616, 8,932,814, 8,945,839, 8,993,233 and 8,999,641; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); US 2015-0184139 (U.S. application Ser. No. 14/324,960); Ser. No. 14/054,414 European Patent Applications EP 2 771 468 (EP13818570.7), EP 2 764 103 (EP13824232.6), and EP 2 784 162 (EP14170383.5); and PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809), WO 2015/089351 (PCT/US2014/069897), WO 2015/089354 (PCT/US2014/069902), WO 2015/089364 (PCT/US2014/069925), WO 2015/089427 (PCT/US2014/070068), WO 2015/089462 (PCT/US2014/070127), WO 2015/089419 (PCT/US2014/070057), WO 2015/089465 (PCT/US2014/070135), WO 2015/089486 (PCT/US2014/070175), PCT/US2015/051691, PCT/US2015/051830. Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013; and May 28, 2013 respectively. Reference is also made to U.S. provisional patent application 61/836,123, filed on Jun. 17, 2013. Reference is additionally made to U.S. provisional patent applications 61/835,931, 61/835,936, 61/835,973, 61/836,080, 61/836,101, and 61/836,127, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013, and 61/961,980 filed on Oct. 28, 2013. Reference is yet further made to: PCT/US2014/62558 filed Oct. 28, 2014, and U.S. Provisional Patent Applications Ser. Nos. 61/915,148, 61/915,150, 61/915,153, 61/915,203, 61/915,251, 61/915,301, 61/915,267, 61/915,260, and 61/915,397, each filed Dec. 12, 2013; 61/757,972 and 61/768,959, filed on Jan. 29, 2013 and Feb. 25, 2013; 62/010,888 and 62/010,879, both filed Jun. 11, 2014; 62/010,329, 62/010,439 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/055,484, 62/055,460 and 62/055,487, each filed Sep. 25, 2014; and 62/069,243, filed Oct. 27, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to PCT application designating, inter alia, the United States, application No. PCT/US14/41806, filed Jun. 10, 2014.

Mention is also made of U.S. application 62/180,709, 17 Jun. 2015, PROTECTED GUIDE RNAS (PGRNAS); U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. applications 62/091,462, 12 Dec. 2014, 62/096,324, 23 Dec. 2014, 62/180,681, 17 Jun. 2015, and 62/237,496, 5 Oct. 2015, DEAD GUIDES FOR CRISPR TRANSCRIPTION FACTORS; U.S. application 62/091,456, 12 Dec. 2014 and 62/180,692, 17 Jun. 2015, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, 62/181,641, 18 Jun. 2015, and 62/181,667, 18 Jun. 2015, RNA-TARGETING SYSTEM; U.S. application 62/096,656, 24 Dec. 2014 and 62/181,151, 17 Jun. 2015, CRISPR HAVING OR ASSOCIATED WITH DESTABILIZATION DOMAINS; U.S. application 62/096,697, 24 Dec. 2014, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 61/939,154, 12 Feb. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. applications 62/054,675, 24 Sep. 2014 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014 and 62/181,690, 18 Jun. 2015, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19 Aug. 2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION. Mention is made of U.S. applications 62/181,663, 18 Jun. 2015 and 62/245,264, 22 Oct. 2015, NOVEL CRISPR ENZYMES AND SYSTEMS, U.S. applications 62/181,675, 18 Jun. 2015, 62/285,349, 22 Oct. 2015, 62/296,522, 17 Feb. 2016, and 62/320,231, 8 Apr. 2016, NOVEL CRISPR ENZYMES AND SYSTEMS, U.S. application 62/232,067, 24 Sep. 2015, U.S. application Ser. No. 14/975,085, 18 Dec. 2015, European application No. 16150428.7, U.S. application 62/205,733, 16 Aug. 2015, U.S. application 62/201,542, 5 Aug. 2015, U.S. application 62/193,507, 16 Jul. 2015, and U.S. application 62/181,739, 18 Jun. 2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15 Aug. 2015, U.S. application 62/180,699, 17 Jun. 2015, and U.S. application 62/038,358, 17 Aug. 2014, each entitled GENOME EDITING USING CAS9 NICKASES.

In addition, mention is made of PCT application PCT/US14/70057, and BI-2013/107 entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS" (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, and of PCT application PCT/US14/70127, and BI-2013/101 entitled "DELIVERY, USE AND THERAPEUTIC APPLICATIONS OF THE CRISPR-CAS SYSTEMS AND COMPOSITIONS FOR GENOME EDITING" (claiming priority from one or more or all of US provisional patent applications: 61/915,176; 61/915,192; 61/915,215; 61/915,107, 61/915,145; 61/915,148; and 61/915,153 each filed Dec. 12, 2013) ("the Eye PCT"), incorporated herein by reference, with respect to a method of preparing an sgRNA-and-Cpf1 protein containing particle comprising admixing a mixture comprising an sgRNA and Cpf1 protein (and optionally HDR template) with a mixture comprising or consisting essentially of or consisting of surfactant, phospholipid, biodegradable polymer, lipoprotein and alcohol; and particles from such a process. For example, wherein Cpf1 protein and sgRNA were mixed together at a suitable, e.g., 3:1 to 1:3 or 2:1 to 1:2 or 1:1, molar ratio, at a suitable temperature, e.g., 15-30° C., e.g., 20-25° C., e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a C1-6 alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cpf1 protein before formulating the entire complex in a particle. Formulations may be made with a different molar ratio of different components known to promote delivery of nucleic acids into cells (e.g., 1,2-dioleoyl-3-trimethylammonium-propane (DOTAP), 1,2-ditetradecanoyl-sn-glycero-3-phosphocholine (DMPC), polyethylene glycol (PEG), and cholesterol). For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; DOTAP 90, DMPC 0, PEG 5, Cholesterol 5; or DOTAP 100, DMPC 0, PEG 0, Cholesterol 0. That application accordingly comprehends admixing sgRNA, Cpf1 protein and components that form a particle; as well as particles from such admixing. Aspects of the instant invention can involve particles; for example, particles using a process analogous to that of the Particle Delivery PCT or that of the Eye PCT, e.g., by admixing a mixture comprising sgRNA and/or Cpf1 as in the instant invention and components that form a particle, e.g., as in the Particle Delivery PCT or in the Eye PCT, to form a particle and particles from such admixing (or, of course, other particles involving sgRNA and/or Cpf1 as in the instant invention). Cpf1 and C2c1 are both Type V CRISPR-Cas proteins that share structure similarity. Unlike Cas9, which generates blunt cuts at the proximal end of PAM, Cpf1 and C2c1 generate staggered cuts at the distal end of PAM. Accordingly, similar systems with C2c1 may be envisaged.

The subject invention may be used as part of a research program wherein there is transmission of results or data. A computer system (or digital device) may be used to receive, transmit, display and/or store results, analyze the data and/or results, and/or produce a report of the results and/or data and/or analysis. A computer system may be understood as a logical apparatus that can read instructions from media (e.g., software) and/or network port (e.g., from the internet), which can optionally be connected to a server having fixed media. A computer system may comprise one or more of a CPU, disk drives, input devices such as keyboard and/or mouse, and a display (e.g., a monitor). Data communication, such as transmission of instructions or reports, can be achieved through a communication medium to a server at a local or a remote location. The communication medium can include any means of transmitting and/or receiving data. For example, the communication medium can be a network connection, a wireless connection, or an internet connection. Such a connection can provide for communication over the World Wide Web. It is envisioned that data relating to the present invention can be transmitted over such networks or connections (or any other suitable means for transmitting information, including but not limited to, mailing a physical report, such as a print-out) for reception and/or for review by a receiver. The receiver can be but is not limited to an individual, or electronic system (e.g., one or more computers, and/or one or more servers). In some embodiments, the computer system comprises one or more processors. Processors may be associated with one or more controllers, calculation units, and/or other units of a computer system, or implanted in firmware as desired. If implemented in software, the routines may be stored in any computer readable memory such as in RAM, ROM, flash memory, a magnetic disk, a laser disk, or other suitable storage medium. Likewise, this software may be delivered to a computing device via any known delivery method including, for example, over a communication channel such as a telephone line, the internet, a wireless connection, etc., or via a transportable medium, such as a computer readable disk, flash drive, etc. The various steps may be implemented as various blocks, operations, tools, modules, and techniques which, in turn, may be implemented in hardware, firmware, software, or any combination of hardware, firmware, and/or software. When implemented in hardware, some or all of the blocks, operations, techniques, etc. may be implemented in, for example, a custom integrated circuit (IC), an application specific integrated circuit (ASIC), a field programmable logic array (FPGA), a programmable logic array (PLA), etc. A client-server, relational database architecture can be used in embodiments of the invention. A client-server architecture is a network architecture in which each computer or process on the network is either a client or a server. Server computers are typically powerful computers dedicated to managing disk drives (file servers), printers (print servers), or network traffic (network servers). Client computers include PCs (personal computers) or workstations on which users run applications, as well as example output devices as disclosed herein. Client computers rely on server computers for resources, such as files, devices, and even processing power. In some embodiments of the invention, the server computer handles all of the database functionality. The client computer can have software that handles all the front-end data management and can also receive data input from users. A machine readable medium comprising computer-executable code may take many forms, including but not limited to, a tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables, copper wire, and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH- EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution. Accordingly, the invention comprehends performing any method herein-discussed and storing and/or transmitting data and/or results therefrom and/or analysis thereof, as well as products from performing any method herein-discussed, including intermediates.

CAS12B (C2C1)

The invention provides C2c1 (Type V-B; Cas12b) effector proteins and orthologues. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may, but need not be, structurally related, or are only partially structurally related. An "orthologue" of a protein as used herein is a protein of a different species which performs the same or a similar function as the protein it is an orthologue of. Orthologous proteins may, but need not be, structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.). See also Shmakov et al. (2015) for application in the field of CRISPR-Cas loci. Homologous proteins may, but need not be, structurally related, or are only partially structurally related.

The C2c1 gene is found in several diverse bacterial genomes, typically in the same locus with cas1, cas2, and cas4 genes and a CRISPR cassette. Thus, the layout of this putative novel CRISPR-Cas system appears to be similar to that of type II-B. Furthermore, similar to Cas9, the C2c1 protein contains an active RuvC-like nuclease, an arginine-rich region, and a Zn finger (absent in Cas9).

The present invention encompasses the use of a C2c1 (Cas12b) effector protein, derived from a C2c1 locus denoted as subtype V-B. Herein such effector proteins are also referred to as "C2c1p", e.g., a C2c1 protein (and such effector protein or C2c1 protein or protein derived from a C2c1 locus is also called "CRISPR enzyme"). Presently, the subtype V-B loci encompasses cas1-Cas4 fusion, cas2, a distinct gene denoted C2c1 and a CRISPR array. C2c1 (CRISPR-associated protein C2c1) is a large protein (about 1100-1300 amino acids) that contains a RuvC-like nuclease domain homologous to the corresponding domain of Cas9 along with a counterpart to the characteristic arginine-rich cluster of Cas9. However, C2c1 lacks the HNH nuclease domain that is present in all Cas9 proteins, and the RuvC-like domain is contiguous in the C2c1 sequence, in contrast to Cas9 where it contains long inserts including the HNH domain. Accordingly, in particular embodiments, the CRISPR-Cas enzyme comprises only a RuvC-like nuclease domain.

C2c1 (also known as Cas12b) proteins are RNA guided nucleases. Its cleavage relies on a tracr RNA to recruit a guide RNA comprising a guide sequence and a direct repeat, where the guide sequence hybridizes with the target nucleotide sequence to form a DNA/RNA heteroduplex. Based on current studies, C2c1 nuclease activity also requires relies on recognition of PAM sequences. C2c1 PAM sequences may be T-rich sequences. In some embodiments, the PAM sequence is 5' TTN 3' or 5' ATTN 3', wherein N is any nucleotide. In a particular embodiment, the PAM sequence is 5' TTC 3'. In a particular embodiment, the PAM is in the sequence of *Plasmodium falciparum.*

C2c1 creates a staggered cut at the target locus, with a 5' overhang, or a "sticky end" at the PAM distal side of the target sequence. In some embodiments, the 5' overhang is 7 nt. See Lewis and Ke, Mol Cell. 2017 Feb. 2; 65(3):377-379.

The invention also provides a CRISPR-C2c1 system encompassing the use of a C2c1 effector protein. In some embodiments, the system comprises: I. a CRISPR-Cas system RNA polynucleotide sequence, wherein the polynucleotide sequence comprises: a crRNA comprising (a) a direct repeat polynucleotide and (b) a guide sequence polynucleotide capable of hybridizing to a target sequence; II. a tracr RNA polynucleotide; and III. a polynucleotide sequence encoding the C2c1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence and the polynucleotide sequence encoding a CRISPR protein is DNA or RNA. The tracr may be fused to the crRNA. For example, the tracr RNA may be fused to the crRNA at the 5' end of the direct repeat. As used herein, the term crRNA refers to CRISPR RNA, and may be used herein interchangeably with the term gRNA or guide RNA. When the tracr is fused to the crRNA of gRNA, such may be referred to as single guide RNA or synthetic guide RNA (sgRNA).

C2c1 creates double strand breaks at the distal end of PAM, in contrast to cleavage at the proximal end of PAM created by Cas9 (Jinek et al., 2012; Cong et al., 2013). It is proposed that Cpf1 mutated target sequences may be susceptible to repeated cleavage by a single gRNA, hence promoting Cpf1's application in HDR mediated genome editing (Front Plant Sci. 2016 Nov. 14; 7:1683). Cpf1 and C2c1 are both Type V CRISPR Cas proteins that share structure similarity. Like C2c1, Cpf1 creates staggered double strand breaks at the distal end of PAM (in contrast to Cas9, which creates blunt cut at the proximal end of PAM), but unlike Cpf1, C2c1 systems employ a tracrRNA. Accordingly, in certain embodiments, the locus of interest is modified by the CRISPR-C2c1 complex via homology directed repair (HR or HDR). In certain embodiments, the locus of interest is modified by the CRISPR-C2c1 complex independent of HR. In certain embodiments, the locus of interest is modified by the CRISPR-C2c1 complex via non-homologous end joining (NHEJ).

C2c1 generates a staggered cut with a 5' overhang, in contrast to the blunt ends generated by Cas9 (Garneau et al., Nature. 2010; 468:67-71; Gasiunas et al., Proc Natl Acad Sci USA. 2012; 109:E2579-2586). This structure of the cleavage product could be particularly advantageous for facilitating non-homologous end joining (NHEJ)-based gene insertion into the mammalian genome (Maresca et al., Genome research. 2013; 23:539-546).

In particular embodiments, the effector protein is a C2c1 effector protein from or originates from an organism from a genus comprising *Alicyclobacillus, Desulfovibrio, Desulfonatronum, Opitutaceae, Tuberibacillus, Bacillus, Brevibacillus, Candidatus, Desulfatirhabdium, Citrobacter,*

*Elusimicrobia, Methylobacterium, Omnitrophica, Phycisphaerae, Planctomycetes, Spirochaetes, Verrucomicrobiaceae, Lentisphaeria*, or *Laceyella.*

In further particular embodiments, the C2c1 effector protein is from or originates from a species selected from *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1 or genbank accession number WP_031386437), *Elusimicrobia bacterium* RIFOXYA12, *Omnitrophica* WOR_2 bacterium RIFCSPHIGHO2, *Opitutaceae bacterium* TAV5 or genbank accession number WP_009513281, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734 or genbank accession number WP_028326052), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060 or genbank accession number WP_043747912), *Alicyclobacillus kakegawensis* (e.g. genbank accession number WP_067936067), *Bacillus* sp. V3-13 (e.g. genbank accession number WP_101661451), *Lentisphaeria bacterium* (e.g., from DCFZ01000012), or *Laceyella_sediminis* (e.g., genbank accession number WP_106341859).

In certain embodiments, the C2c1 effector protein is from or originates from a species selected from the genus *Alicyclobacillus, Bacillus, Desulfatirhabdium, Desulfonatronum, Lentisphaeria, Laceyella, Methylobacterium*, or *Opitutaceae.*

In certain embodiments, the C2c1 effector protein is from or originates from a species selected from *Alicyclobacillus kakegawensis, Bacillus* sp. V3-13, *Desulfatirhabdium butyrativorans, Desulfonatronum thiodismutans, Lentisphaeria bacterium, Laceyella sediminis, Methylobacterium nodulans*, or *Opitutaceae bacterium.*

In certain embodiments, the C2c1 effector protein is from or originates from a species selected from *Alicyclobacillus kakegawensis* wherein the wild type sequence corresponds to the sequence of WP_067936067, *Bacillus* sp.V3-13 wherein the wild type sequence corresponds to the sequence of WP_101661451, *Desulfatirhabdium butyrativorans* wherein the wild type sequence corresponds to the sequence of WP_028326052, *Desulfonatronum thiodismutans* wherein the wild type sequence corresponds to the sequence of WP_031386437, *Lentisphaeria bacterium* wherein the wild type sequence corresponds to the sequence of DCFZ01000012, *Laceyella sediminis* wherein the wild type sequence corresponds to the sequence of WP_106341859, *Methylobacterium nodulans* wherein the wild type sequence corresponds to the sequence of WP_043747912, or *Opitutaceae bacterium* wherein the wild type sequence corresponds to the sequence of WP_009513281.

In certain embodiments, the C2c1 effector protein is from or originates from a species selected from Table 1 and has a wild type sequence as indicated in Table 1. It will be understood that mutated or truncated Cas12b proteins as described herein elsewhere may deviate from the sequence indicated.

TABLE 1

Cas12b ortholoques

| Species | Sequence |
|---|---|
| *Alicyclobacillus kakegawensis* (SEQ ID NO: 379) | MAVKSIKVKLRLSECPDILAGMWQLHRATNAG<br>VRYYTEWVSLMRQEILYSRGPDGGQQCYMTAE<br>DCQRELLRRLRNRQLHNGRQDQPGTDADLLAI<br>SRRLYEILVLQSIGKRGDAQQIASSFLSPLVD<br>PNSKGGRGEAKSGRKPAWQKMRDQGDPRWVAA<br>REKYEQRKAVDPSKEILNSLDALGLRPLFAVF<br>TETYRSGVDWKPLGKSQGVRTWDRDMFQQALE<br>RLMSWESWNRRVGEEYARLFQQKMKFEQEHFA<br>EQSHLVKLARALEADMRAASQGFEAKRGTAHQ<br>ITRRALRGADRVFEIWKSIPEEALFSQYDEVI<br>RQVQAEKRRDFGSHDLFAKLAEPKYQPLWRAD<br>ETFLTRYALYNGVLRDLEKARQFATFTLPDAC<br>VNPIWTRFESSQGSNLHKYEFLFDHLGPGRHA<br>VRFQRLLVVESEGAKERDSVVVPVAPSGQLDK<br>LVLREEEKSSVALHLHDTARPDGFMAEWAGAK<br>LQYERSTLARKARRDKQGMRSWRRQPSMLMSA<br>AQMLEDAKQAGDVYLNISVRVKSPSEVRGQRR<br>PPYAALFRIDDKQRRVTVNYNKLSAYLEEHPD<br>KQIPGAPGLLSGLRVMSVDLGLRTSASISVFR<br>VAKKEEVEALGDGRPPHYYPIHGTDDLVAVHE<br>RSHLIQMPGETETKQLRKLREERQAVLRPLFA<br>QLALLRLLVRCGAADERIRTRSWQRLTKQGRE<br>FTKRLTPSWREALELELTRLEAYCGRVPDDEW<br>SRIVDRTVIALWRRMGKQVRDWRKQVKSGAKV<br>KVKGYQLDVVGGNSLAQIDYLEQQYKFLRRWS<br>FFARASGLVVRADRESHFAVALRQHIENAKRD<br>RLKKLADRILMEALGYVVYEASGPREGQWTAQH<br>PPCQLIILEELSAYRFSDDRPPSENSKLMAWG<br>HRGILEELVNQAQVHDVLVGTVYAAFSSRFDA<br>RTGAPGVRCRRVPARFVGATVDDSLPLWLTEF<br>LDKHRLDKNLLRPDDVIPTGEGEFLVSPCGEE<br>AARVRQVHADINAAQNLQRRLWQNFDITELRL<br>RCDVKMGGEGTVLVPRVNNARAKQLFGKKVLV<br>SQDGVTFFERSQTGGKPHSEKQTDLTDKELEL<br>IAEADEARAKSVVLFRDPSGHIGKGHWIRQRE<br>FWSLVKQRIESHTAERIRVRGVGSSLD |
| *Bacillus* sp._V3-13 (SEQ ID NO: 380) | MAIRSIKLKMKTNSGTDSIYLRKALWRTHQLI<br>NEGIAYYMNLLTLYRQEAIGDKTKEAYQAELI<br>NIIRNQQRNNGSSEEHGSDQEILALLRQLYEL<br>IIPSSIGESGDANQLGNKFLYPLVDPNSQSGK<br>GTSNAGRKPRWKRLKEEGNPDWELEKKKDEER<br>KAKDPTVKIFDNLNKYGLLPLFPLFTNIQKDI<br>EWLPLGKRQSVRKWDKDMFIQAIERLLSWESW<br>NRRVADEYKQLKEKTESYYKEHLTGGEEWIEK<br>IRKFEKERNMELEKNAFAPNDGYFITSRQIRG<br>WDRVYEKWSKLPESASPEELWKVVAEQQNKMS<br>EGFGDPKVFSFLANRENRDIWRGHSERIYHIA<br>AYNGLQKKLSRTKEQATFTLPDAIEHPLWIRY<br>ESPGGTNLNLFKLEEKQKKNYYVTLSKIIWPS<br>EEKWIEKENIEIPLAPSIQFNRQIKLKQHVKG<br>KQEISFSDYSSRISLDGVLGGSRIQFNRKYIK<br>NHKELLGEGDIGPVFFNLVVDVAPLQETRNGR<br>LQSPIGKALKVISSDFSKVIDYKPKELMDWMN<br>TGSASNSFGVASLLEGMRVMSIDMGQRTSASV<br>SIFEVVKELPKDQEQKLFYSINDTELFAIHKR<br>SFLLNLPGEVVTKNNKQQRQERRKKRQFVRSQ<br>IRMLANVLRLETKKTPDERKKAIHKLMEIVQS<br>YDSWTASQKEVWEKELNLLTNMAAFNDEIWKE<br>SLVELHHRIEPYVGQIVSKWRKGLSEGRKNLA<br>GISMWNIDELEDTRRLLISWSKRSRTPGEANR<br>IETDEPFGSSLLQHIQNVKDDRLKQMANLIIM<br>TALGFKYDKEEKDRYKRWKETYPACQIILFEN<br>LNRYLFNLDRSRRENSRLMKWAHRSIPRTVSM<br>QGEMFGLQVGDVRSEYSSRFHAKTGAPGIRCH<br>ALTEEDLKAGSNTLKRLIEDGFINESELAYLK<br>KGDIIPSQGGELFVTLSKRYKKDSDNNELTVI<br>HADINAAQNLQKRFWQQNSEVYRVPC<br>QLARMGEDKLYIPKSQTETIKKYFGKGSFVK<br>NNTEQEVYKWEKSEKMKIKTDTTFDLQDLDG<br>FEDISKTIELAQEQQKKYLTMFRDPSGYFFN<br>NETWRPQKEYWSIVNNIIKSCLKKKILSNKV<br>EL |

TABLE 1-continued

| Cas12b orthologues | |
|---|---|
| Species | Sequence |
| *Desulfatirhabdium butyrativorans* (SEQ ID NO: 381) | MPLSNNPPVTQRAYTLRLRGADPSDLSWREA<br>LWHTHEAVNKGAKVFGDWLLTLRGGLDHTLA<br>DTKVKGGKGKPDRDPTPEERKARRILLALSW<br>LSVESKLGAPSSYIVASGDEPAKDRNDNVVS<br>ALEEILQSRKVAKSEIDDWKRDCSASLSAAI<br>RDDAVWVNRSKVFDEAVKSVGSSLTREEAWD<br>MLERFFGSRDAYLTPMKDPEDKSSETEQEDK<br>AKDLVQKAGQWLSSRYGTSEGADFCRMSDIY<br>GKIAAWADNASQGGSSTVDDLVSELRQHFDT<br>KESKATNGLDWIIGLSSYTGHTPNPVHELLR<br>QNTSLNKSHLDDLKKKANTRAESCKSKIGSK<br>GQRPYSDAILNDVESVCGFTYRVDKDGQPVS<br>VADYSKYDVDYKWGTARHYIFAVMLDHAARR<br>ISLAHKWIKRAEAERHKFEEDAKRIANVPAR<br>AREWLDSFCKERSVTSGAVEPYRIRRRAVDG<br>WKEVVAAWSKSDCKSTEDRIAAARALQDDSE<br>IDKFGDIQLFEALAEDDALCVWHKDGEATNE<br>PDFQPLIDYSLAIEAEFKKRQFKVPAYRHPD<br>ELLHPVFCDFGKSRWKINYDVHKNVQAPFYR<br>GLCLTLWTGSEIKPVPLCWQSKRLTRDLALG<br>NNHRNDAASAVTRADRLGRAASNVTKSDMVN<br>ITGLFEQADWNGRLQAPRQQLEAIAWRDNPR<br>LSEQERNLRMCGMIEHIRWLVTFSVKLQPQG<br>PWCAYAEQHGLNTNPQYWPHADTNRDRKVHA<br>RLILPRLPGLRVLSVDLGHRYAAACAVWEAV<br>NTETVKEACQNVGRDMPKEHDLYLHIKVKKQ<br>GIGKQTEVDKTTIYRRIGADTLPDGRPHPAP<br>WARLDRQFLIKLQGEEKDAREASNEEIWALH<br>QMECKLDRTKPLIDRLIASGWGLLKRQMARL<br>DALKELGWIPAPDSSENLSREDGEAKDYRES<br>LAVDDLMFSAVRTLRLALQRHGNRARIAYYL<br>ISEVKIRPGGIQEKLDENGRIDLLQDALALW<br>HELFSSPGWRDEAAKQLWDSRIATLAGYKAP<br>EENGDNVSDVAYRKKQQVYREQLRNVAKTLS<br>GDVITCKELSDAWKERWEDEDQRWKKLLRWF<br>KDWVLPSGTQANNATIRNVGGLSLSRLATIT<br>EFRRKVQVGFFTRLRPDGTRHEIGEQFGQKT<br>LDALELLREQRVKQLASRIAEAALGIGSEGG<br>KGWDGGKRPRQRINDSRFAPCHAVVIENLAN<br>YRPDETRTRLENRRLMTWSASKVHKYLSEAC<br>QLNGLYLCTVSAWYTSRQDSRTGAPGIRCQD<br>VSVREFMQSPFWRKQVKQAEAKHDENKGDAR<br>ERFLCELNKTWKAKTPAEWKKAGFVRIPLRG<br>GEIFVSADSKSPSAKGIHADLNAAANIGLRA<br>LTDPDWPGKWWYVPCDPVSFESKMDYVKGCA<br>AVKVGQPLRQPAQTNADGAASKIRKGKKNRT<br>AGTSKEKVYLWRDISAFPLESNEIGEWKETS<br>AYQNDVQYRVIRMLKEHIKSLDNRTGDNVEG |
| *Desulfonatronum thiodismutans* (SEQ ID NO: 382) | MVLGRKDDTAELRRALWTTHEHVNLAVAEVE<br>RVLLRCRGRSYWTLDRRGDPVHVPESQVAED<br>ALAMAREAQRRNGWPVVGEDEEILLALRYLY<br>EQIVPSCLLDDLGKPLKGDAQKIGTNYAGPL<br>FDSDTCRRDEGKDVACCGPFHEVAGKYLGAL<br>PEWATPISKQEFDGKDASHLRFKATGGDDAF<br>FRVSIEKANAWYEDPANQDALKNKAYNKDDW<br>KKEKDKGISSWAVKYIQKQLQLGQDPRTEVR<br>RKLWLELGLLPLFIPVFDKTMVGNLWNRLAV<br>RLALAHLLSWESWNHRAVQDQALARAKRDEL<br>AALFLGMEDGFAGLREYELRRNESIKQHAFE<br>PVDRPYVVSGRALRSWTRVREEWLRHGDTQE<br>SRKNICNRLQDRLRGKFGDPDVFHWLAEDGQ<br>EALWKERDCVTSFSLLNDADGLLEKRKGYAL<br>MTFADARLHPRWAMYEAPGGSNLRTYQIRKT<br>ENGLWADVVLLSPRNESAAVEEKTFNVRLAP<br>SGQLSNVSFDQIQKGSKMVGRCRYQSANQQF<br>EGLLGGAEILFDRKRIANEQHGATDLASKPG<br>HVWFKLTLDVRPQAPQGWLDGKGRPALPPEA<br>KHFKTALSNKSKFADQVRPGLRVLSVDLGVR<br>SFAACSVFELVRGGPDQ<br>GTYFPAADGRTVDDPEKLWAKHERSFKIT<br>LPGENPSRKEEIARRAAMEELRSLNGDIR<br>RLKAILRLSVLQEDDPRTEHLRLFMEAIV<br>DDPAKSALNAELFKGFGDDRFRSTPDLWK<br>QHCHFFHDKAEKVVAERFSRWRTETRPKS<br>SSWQDWRERRGYAGGKSYWAVTYLEAVRG<br>LILRWNMRGRTYGEVNRQDKKQFGTVASA<br>LLHHINQLKEDRIKTGADMIIQAARGFVP<br>RKNGAGWVQVHEPCRLILFEDLARYRFRT<br>DRSRRENSRLMRWSHREIVNEVGMQGELY<br>GLHVDTTEAGFSSRYLASSGAPGVRCRHL<br>VEEDFHDGLPGMHLVGELDWLLPKDKDRT<br>ANEARRLLGGMVRPGMLVPWDGGELFATL<br>NAASQLHVIHADINAAQNLQRRFWGRCGE<br>AIRIVCNQLSVDGSTRYEMAKAPKARLLG<br>ALQQLKNGDAPFHLTSIPNSQKPENSYVM<br>TPTNAGKKYRAGPGEKSSGEEDELALDIV<br>EQAEELAQGRKTFFRDPSGVFFAPDRWLP<br>SEIYWSRIRRRIWQVTLERNSSGRQERAE<br>MDEMPY |
| *Lentisphaeria bacterium* (SEQ ID NO: 383) | MAVELNRIYQGRVNHVYIFDENQNQVSVD<br>NGDDLLFVHHELYQDAINYYLVALAAMAL<br>DSKDSLFGKFKMQIRAVWNDFYRNGQLRP<br>GLKHSLIRSLGHAAELNTSNGADIAMNLI<br>LEDGGIPSEILNAALEHLAEKCTGDVSQL<br>GKTFFPRFCDTAYHGNWDVDAKSFSEKKG<br>RQRLVDALYSLHPVQAVQELAPEIEIGWG<br>GVKTQTGKFFTGDEAKASLKKAISYFLQD<br>TGKNSPELQEYFSVAGKQPLEQYLGKIDT<br>FPEISFGRISSHQNINISNAMWILKFFPD<br>QYSVDLIKNLIPNKKYEIGIAPQWGDDPV<br>KLSRGKRGYTFRAFTDLAMWEKNWKVFDR<br>AAFSDALKTINQFRNKTQERNDQLKRYCA<br>ALNWMDGESSDKKPPVEPADADAVDEAAT<br>SVLPILAGDKRWNALLQLQKELGICNDFT<br>ENELMDYGLSLRTIRGYQKLRSMMLEKEE<br>KMRAKTADDEEISQALQEIIIKFQSSHRD<br>TIGSVSLFLKLAEPKYFCVWHDADKNQNF<br>ASVDMVADAVRYYSYQEEKARLEEPIQIT<br>PADARYSRRVSDLYALVYKNAKECKTGYG<br>LRPDGNFVFEIAQKNAKGYAPAKVVLAFS<br>APRLKRDGLIDKEFSAYYPPVLQAFLREE<br>EAPKQSFKTTAVILMPDWDKNGKRRILLN<br>FPIKLDVSAIHQKTDHRFENQFYFANNTN<br>TCLLWPSYQYKKPVTWYQGKKPFDVVAVD<br>LGQRSAGAVSRITVSTEKREHSVAIGEAG<br>GTQWYAYRKFSGLLRLPGEDATVIRDGQR<br>TEELSGNAGRLSTEEETVQACVLCKMLIG<br>DATLLGGSDEKTIRSFPKQNDKLLIAFRR<br>ATGRMKQLQRWLWMLNENGLCDKAKTEIS<br>NSDWLVNKNIDNVLKEEKQHREMLPAILL<br>QIADRVLPLRGRKWDWVLNPQSNSFVLQQ<br>TAHGSGDPHKKICGQRGLSFARIEQLESL<br>RMRCQALNRILMRKTGEKPATLAEMRNNP<br>IPDCCPDILMRLDAMKEQRINQTANLILA<br>QALGLRHCLHSESATKRKENGMHGEYEKI<br>PGVEPAAFVVLEDLSRYRFSQDRSSYENS<br>RLMKWSHRKILEKLALLCEVFNVPILQVG<br>AAYSSKFSANAIPGFRAEECSIDQLSFYP<br>WRELKDSREKALVEQIRKIGHRLLTFDAK<br>ATIIMPRNGGPVFIPFVPSDSKDTLIQAD<br>INASFNIGLRGVADATNLLCNNRVSCDRK<br>KDCWQVKRSSNFSKMVYPEKLSLSFDPIK<br>KQEGAGGNFFVLGCSERILTGTSEKSPVF<br>TSSEMAKKYPNLMFGSALWRNEILKLERC<br>CKINQSRLDKFIAKKEVQNEL |
| *Laceyella sediminis* (SEQ ID NO: 384) | MSIRSFKLKIKTKSGVNAEELRRGLWRTH<br>QLINDGIAYYMNWLVLLRQEDLFIRNEET<br>NEIEKRSKEEIQGELLERVHKQQQRNQWS<br>GEVDDQTLLQTLRHLYEEIVPSVIGKSGN<br>ASLKARFFLGPLVDPNNKTTKDVSKSGPT<br>PKWKKMKDAGDPNWVQEYEKYMAERQTLV<br>RLEEMGLIPLFPMYTDEVGDIHWLPQASG<br>YTRTWDRDMFQQAIERLLSWESWNRRVRE<br>RRAQFEKKTHDFASRFSESDVQWMNKLRE<br>YEAQQEKSLEENAFAPNEPYALTKKALRG<br>WERVYHSWMRLDSAASEEAYWQEVATCQT<br>AMRGEFGDPAIYQFLAQKENHDIWRGYPE<br>RVIDFAELNHLQRELRRAKE |

TABLE 1-continued

Cas12b orthologues

| Species | Sequence |
|---|---|
| | DATFTLPDSVDHPLWVRYEAPGGTNIHGY<br>DLVQDTKRNLTLILDKFILPDENGSWHEV<br>KKVPFSLAKSKQFHRQVWLQEEQKQKKRE<br>VVFYDYSTNLPHLGTLAGAKLQWDRNFLN<br>KRTQQQIEETGEIGKVFFNISVDVRPAVE<br>VKNGRLQNGLGKALTVLTHPDGTKIVTGW<br>KAEQLEKWVGESGRVSSLGLDSLSEGLRV<br>MSIDLGQRTSATVSVFEITKEAPDNPYKF<br>FYQLEGTELFAVHQRSFLLALPGENPPQK<br>IKQMREIRWKERNRIKQQVDQLSAILRLH<br>KKVNEDERIQAIDKLLQKVASWQLNEEIA<br>TAWNQALSQLYSKAKENDLQWNQAIKNAH<br>HQLEPVVGKQISLWRKDLSTGRQGIAGLS<br>LWSIEELEATKKLLTRWSKRSREPGVVKR<br>IERFETFAKQIQHHINQVKENRLKQLANL<br>IVMTALGYKYDQEQKKWIEVYPACQWLFE<br>NLRSYRFSYERSRRENKKLMEWSHRSIPK<br>LVQMQGELFGLQVADVYAAYSSRYHGRTG<br>APGIRCHALTEADLRNETNIIHELIEAGF<br>IKEEHRPYLQQGDLVPWSGGELFATLQKP<br>YDNPRILTLHADINAAQNIQKRFWHPSMW<br>FRVNCESVMEGEIVTYVPKNKTVHKKQGK<br>TFRFVKVEGSDVYEWAKWSKNRNKNTFSS<br>ITERKPPSSMILFRDPSGTFFKEQEWVEQ<br>KTFWGKVQSMIQAYMKKTIVQRMEE |
| *Methylobacterium nodulans* (long form) (SEQ ID NO: 385) | MYEAIVLADDANAQLANAFLGPLTDPNSA<br>GFLEAFNKVDRPAPSWLDQVPASDPIDPA<br>VLAEANAWLDTDAGRAWLVDTGAPPRWRS<br>LAAKQDPIWPREFARKLGELRKEAASGTS<br>AIIKALKRDFGVLPLFQPSLAPRILGSRS<br>SLTPWDRLAFRLAVGHLLSWESWCTRARD<br>EHTARVQRLEQFSSAHLKGDLATKVSTLR<br>EYERARKEQIAQLGLPMGERDFLITVRMT<br>RGWDDLREKWRRSGDKGQEALHAIIATEQ<br>TRKRGRFGDPDLFRWLARPENMHVWADGH<br>ADAVGVLARVNAMERLVERSRDTALMTLP<br>DPVAHPRSAQWEAEGGSNLRNYQLEAVGG<br>ELQITLPLLKAADDGRCIDTPLSFSLAPS<br>DQLQGVVLTKQDKQQKITYCTNMNEVFEA<br>KLGSADLLLNWDHLRGRIRDRVDAGDIGS<br>AFLKLALDVAHVLPDGVDDQLARAAFHFQ<br>SAKGAKSKHADSVQAGLRVLSIDLGVRSF<br>ATCSVFELKDTAPTTGVAFPLAEFRLWAV<br>HERSFTLELPGENVGAAGQQWRAQADAEL<br>RQLRGGLNRHRQLLRAATVQKGERDAYLT<br>DLREAWSAKELWPFEASLLSELERCSTVA<br>DPLWQDTCKRAARLYRTEFGAVVSEWRSR<br>TRSREDRKYAGKSMWSVQHLTDVRRFLQS<br>WSLAGRASGDIRRLDRERGGVFAKDLLDH<br>IDALKDDRLKTGADLIVQAARGFQRNEFG<br>YWVQKHAPCHVILFEDLSRYRMRTDRPRR<br>ENSQLMQWAHRGVPDMVGMQGEIYGIQDR<br>RDPDSARKHARQPLAAFCLDTPAAFSSRY<br>HASTMTPGIRCHPLRKREFEDQGFLELLK<br>RENEGLDLNGYKPGDLVPLPGGEVFVCLN<br>ANGLSRIHADINAAQNLQRRFWTQHGDAF<br>RLPCGKSAVQGQIRWAPLSMGKRQAGALG<br>GFGYLEPTGHDSGSCQWRKTTEAEWRRLS<br>GAQKDRDEAAAAEDEELQGLEEELLERSG<br>ERVVFFRDPSGWLPTDLWFPSAAFWSIVR<br>AKTVGRLRSHLDAQAEASYAVAAGL |
| *Opitutaceae bacterium* (SEQ ID NO: 386) | MSLNRIYQGRVAAVETGTALAKGNVEWMP<br>AAGGDEVLWQHHELFQAAINYYLVALLAL<br>ADKNNPVLGPLISQMDNPQSPYHVWGSFR<br>RQGRQRTGLSQAVAPYITPGNNAPTLDEV<br>FRSILAGNPTDRATLDAALMQLLKACDGA<br>GAIQQEGRSYWPKFCDPDSTANFAGDPAM<br>LRREQHRLLLPQVLHDPAITHDSPALGSF<br>DTYSIATPDTRTPQLTGPKARARLEQAIT<br>LWRVRLPESAADFDRLASSLKKIPDDDSR<br>LNLQGYVGSSAKGEVQARLFALLLFRHLE<br>RSSFTLGLLRSATPPPKNAETPPPAGVPL<br>PAASAADPVRIARGKRSFVFRAFTSLPCW<br>HGGDNIHPTWKSFDIAAFKYALTVINQIE |

TABLE 1-continued

Cas12b orthologues

| Species | Sequence |
|---|---|
| | EKTKERQKECAELETDFDYMHGRLAKIPV<br>KYTTGEAEPPPILANDLRIPLLRELLQNI<br>KVDTALTDGEAVSYGLQRRTIRGFRELRR<br>IWRGHAPAGTVFSSELKEKLAGELRQFQT<br>DNSTTIGSVQLFNELIQNPKYW<br>PIWQAPDVETARQWADAGFADDPLAALV<br>QEAELQEDIDALKAPVKLTPADPEYSRR<br>QYDFNAVSKFGAGSRSANRHEPGQTERG<br>HNTFTTEIAARNAADGNRWRATHVRIHY<br>SAPRLLRDGLRRPDTDGNEALEAVPWLQ<br>PMMEALAPLPTLPQDLTGMPVFLMPDVT<br>LSGERRILLNLPVTLEPAALVEQLGNAG<br>RWQNQFFGSREDPFALRWPADGAVKTAK<br>GKTHIPWHQDRDHFTVLGVDLGTRDAGA<br>LALLNVTAQKPAKPVHRIIGEADGRTWY<br>ASLADARMIRLPGEDARLFVRGKLVQEP<br>YGERGRNASLLEWEDARNIILRLGQNPD<br>ELLGADPRRHSYPEINDKLLVALRRAQA<br>RLARLQNRSWRLRDLAESDKALDEIHAE<br>RAGEKPSPLPPLARDDAIKSTDEALLSQ<br>RDIIRRSFVQIANLILPLRGRRWEWRPH<br>VEVPDCHILAQSDPGTDDTKRLVAGQRG<br>ISHERIEQIEELRRRCQSLNRALRHKPG<br>ERPVLGRPAKGEEIADPCPALLEKINRL<br>RDQRVDQTAHAILAAALGVRLRAPSKDR<br>AERRHRDIHGEYERFRAPADFVVIENLS<br>RYLSSQDRARSENTRLMQWCHRQIVQKL<br>RQLCETYGIPVLAVPAAYSSRFSSRDGS<br>AGFRAVHLTPDHRHRMPWSRILARLKAH<br>EEDGKRLEKTVLDEARAVRGLFDRLDRF<br>NAGHVPGKPWRTLLAPLPGGPVFVPLGD<br>ATPMQADLNAAINIALRGIAAPDRHDIH<br>HRLRAENKKRILSLRLGTQREKARWPGG<br>APAVTLSTPNNGASPEDSDALPERVSNL<br>FVDIAGVANFERVTIEGVSQKFATGRGL<br>WASVKQRAWNRVARLNETVTDNNRNEEE<br>DDIPM |
| *Bacillus* sp. NSP2.1 (SEQ ID NO: 387) | MAIRSIKLKLKTHTGPEAQNLRKGIWRT<br>HRLLNEGVAYYMKMLLLFRQESTGERPK<br>EELQEELICHIREQQQRNQADKNTQALP<br>LDKALEALRQLYELLVPSSVGQSGDAQI<br>ISRKFLSPLVDPNSEGGKGTSKAGAKPT<br>WQKKKEANDPTWEQDYEKWKKRREEDPT<br>ASVITTLEEYGIRPIFPLYTNTVTDIAW<br>LPLQSNQFVRTWDRDMLQQAIERLLSWE<br>SWNKRVQEEYAKLKEKMAQLNHQLHGGQ<br>EWISLLEQYEENRERELRENMTAANDKY<br>RITKRQIVIKGWNELYELWSTFPASASH<br>EQYKEALKRVQQRLRGRFGDAHFFQYLM<br>EEKNRLIWKGNPQRIHYFVARNELTKRL<br>EEAKQSATMTLPNARKHPLWVRFDARGG<br>NLQDYYLTAEADKPRSRRFVTFSQLIWP<br>SESGWMEKKDVEVELALSRQFYQQVKLL<br>KNDKGKQKIEFKDKGSGSTFNGHLGGAK<br>LQLERGDLEKEEKNFEDGEIGSVYLNVV<br>IDFEPLQEVKNGRVQAPYGQVLQLIRRP<br>NEFPKVTTYKSEQLVEWIKASPQHSAGV<br>ESLASGFRVMSIDLGLRAAAATSIFSVE<br>ESSDKNAADFSYWIEGTPLVAVHQRSYM<br>LRLPGEQVEKQVMEKRDERFQLHQRVKF<br>QIRVLAQIMRMANKQYGDRWDELDSLKQ<br>AVEQKKSPLDQTDRTFWEGIVCDLTKVL<br>PRNEADWEQAVVQIHRKAEEYVGKAVQA<br>WRKRFAADERKGIAGLSMWNIEELEGLR<br>KLLISWSRRTRNPQEVNRFERGHTSHQR<br>LLTHIQNVKEDRLKQLSHAIVMTALGYV<br>YDERKQEWCAEYPACQVILFENLSQYRS<br>NLDRSTKENSTLMKWAHRSIPKYVHMQA<br>EPYGIQIGDVRAEYSSRFYAKTGTPGIR<br>CKKVRGQDLQGRRFENLQKRLVNEQFLT<br>EEQVKQLRPGDIVPDDSGELFMTLTDGS<br>GSKEVVFLQADINAAHNLQKRFWQRYNE<br>LFKVSCRVIVRDEEEYLVPKTKSVQAKL<br>GKGLFVKKSDTAWKDVYVWDSQAKLKGK<br>TTFTEESESPEQLEDFQEIIEEAEEAKG |

TABLE 1-continued

| Cas12b ortholoques | |
|---|---|
| Species | Sequence |
| | TYRTLFRDPSGVFFPESVWYPQKDFWGE<br>VKRKLYGKLRERFLTKAR |
| *Methylobacterium nodulans* (short form) (SEQ ID NO: 388) | MLTKQDKQQKITYCTNMNEVFEAKLGSA<br>DLLLNWDHLRGRIRDRVDAGDIGSAFLK<br>LALDVAHVLPDGVDDQLARAAFHFQSAK<br>GAKSKHADSVQAGLRVLSIDLGVRSFAT<br>CSVFELKDTAPTTGVAFPLAEFRLWAVH<br>ERSFTLELPGENVGAAGQQWRAQADAEL<br>RQLRGGLNRHRQLLRAATVQKGERDAYL<br>TDLREAWSAKELWPFEASLLSELERCST<br>VADPLWQDTCKRAARLYRTEFGAVVSEW<br>RSRTRSREDRKYAGKSMWSVQHLTDVRR<br>FLQSWSLAGRASGDIRRLDRERGGVFAK<br>DLLDHIDALKDDRLKTGADLIVQAARGF<br>QRNEFGYWVQKHAPCHVILFEDLSRYRM<br>RTDRPRRENSQLMQWAHRGVPDMVGMQG<br>EIYGIQDRRDPDSARKHARQPLAAFCLD<br>TPAAFSSRYHASTMTPGIRCHPLRKREF<br>EDQGFLELLKRENEGLDLNGYKPGDLVP<br>LPGGEVFVCLNANGLSRIHADINAAQNL<br>QRRFWTQHGDAFRLPCGKSAVQGQIRWA<br>PLSMGKRQAGALGGFGYLEPTGHDSGSC<br>QWRKTTEAEWRRLSGAQKDRDEAAAAED<br>EELQGLEEELLERSGERWFFRDPSGVVL<br>PTDLWFPSAAFWSIVRAKTVGRLRSHLD<br>AQAEASYAVAAGL |

In certain embodiments, the C2c1 effector protein is from or originates from a species selected from the genus *Lentisphaeria* or *Laceyella.*

In certain embodiments, the C2c1 effector protein is from or originates from a species selected from *Alicyclobacillus kakegawensis, Bacillus* sp._V3-13, *Lentisphaeria* bacterium, or *Laceyella sediminis.*

In certain embodiments, the C2c1 effector protein is from or originates from a species selected from *Alicyclobacillus kakegawensis* wherein the wild type sequence corresponds to the sequence of WP_067936067, *Bacillus* sp._V3-13 wherein the wild type sequence corresponds to the sequence of WP_101661451*, Lentisphaeria bacterium* wherein the wild type sequence corresponds to the sequence of DCFZ01000012, or *Laceyella sediminis* wherein the wild type sequence corresponds to the sequence of WP_106341859.

In certain embodiments, the C2c1 effector protein is from or originates from a species selected from Table 2 and has a wild type sequence as indicated in Table 2. It will be understood that mutated or truncated Cas12b proteins as described herein elsewhere may deviate from the sequence indicated.

TABLE 2

| Cas12b ortholoques | |
|---|---|
| Species | Sequence |
| *Alicyclobacillus kakegawensis* (SEQ ID NO: 389) | MAVKSIKVKLRLSECPDILAGMWQLHRA<br>TNAGVRYYTEWVSLMRQEILYSRGPDGG<br>QQCYMTAEDCQRELLRRLRNRQLHNGRQ<br>DQPGTDADLLAISRRLYEILVLQSIGKR<br>GDAQQIASSFLSPLVDPNSKGGRGEAKS<br>GRKPAWQKMRDQGDPRWVAAREKYEQRK<br>AVDPSKEILNSLDALGLRPLFAVFTETY<br>RSGVDWKPLGKSQGVRTWDRDMFQQALE<br>RLMSWESWNRRVGEEYARLFQQKMKFEQ<br>EHFAEQSHLVKLARALEADMRAASQGFE<br>AKRGTAHQITRRALRGADRVFEIWKSIP |

TABLE 2-continued

| Cas12b ortholoques | |
|---|---|
| Species | Sequence |
| | EEALFSQYDEVIRQVQAEKRRDFGSHDL<br>FAKLAEPKYQPLWRADETFLTRYALYNG<br>VLRDLEKARQFATFTLPDACVNPIWTRF<br>ESSQGSNLHKYEFLFDHLGPGRHAVRFQ<br>RLLVVESEGAKERDSVVVPVAPSGQLDK<br>LVLREEEKSSVALHLHDTARPDGFMAEW<br>AGAKLQYERSTLARKARRDKQGMRSW<br>RRQPSMLMSAAQMLEDAKQAGDVYLNIS<br>VRVKSPSEVRGQRRPPYAALFRIDDKQR<br>RVTVNYNKLSAYLEEHPDKQIPGAPGLL<br>SGLRVMSVDLGLRTSASISVFRVAKKEE<br>VEALGDGRPPHYYPIHGTDDLVAVHERS<br>HLIQMPGETETKQLRKLREERQAVLRPL<br>FAQLALLRLLVRCGAADERIRTRSWQRL<br>TKQGREFTKRLTPSWREALELELTRLEA<br>YCGRVPDDEWSRIVDRTVIALWRRMGKQ<br>VRDWRKQVKSGAKVKVKGYQLDVVGGNS<br>LAQIDYLEQQYKFLRRWSFFARASGLVV<br>RADRESHFAVALRQHIENAKRDRLKKLA<br>DRILMEALGYVYEASGPREGQWTAQHPP<br>CQLIIILEELSAYRFSDDRPPSENSKLMA<br>WGHRGILEELVNQAQVHDVLVGTVYAAF<br>SSRFDARTGAPGVRCRRVPARFVGATVD<br>DSLPLWLTEFLDKHRLDKNLLRPDDVIP<br>TGEGEFLVSPCGEEAARVRQVHADINAA<br>QNLQRRLWQNFDITELRLRCDVKMGGEG<br>TVLVPRVNNARAKQLFGKKVLVSQDGVT<br>FFERSQTGGKPHSEKQTDLTDKELELIA<br>EADEARAKSVVLFRDPSGIIIGKGIIWI<br>RQREFWSLYKQRIESHTAERIRVRGVGS<br>SLD |
| *Bacillus* sp._ V3-13 (SEQ ID NO: 390) | MAIRSIKLKMKTNSGTDSIYLRKALWRT<br>HQLINEGIAYYMNLLTLYRQEAIGDKTK<br>EAYQAELINIIRNQQRNNGSSEEHGSDQ<br>EILALLRQLYELIIPSSIGESGDANQLG<br>NKFLYPLVDPNSQSGKGTSNAGRKPRWK<br>RLKEEGNPDWELEKKKDEERKAKDPTVK<br>IFDNLNKYGLLPLFPLFTNIQKDIEWLP<br>LGKRQSVRKWDKDMFIQAIERLLSWESW<br>NRRVADEYKQLKEKTESYYKEHLTGGEE<br>WIEKIRKFEKERNMELEKNAFAPNDGYF<br>ITSRQIRGWDRVYEKWSKLPESASPEEL<br>WKWAEQQNKMSEGFGDPKVFSFLANREN<br>RDIWRGHSERIYHIAAYNGLQKKLSRTK<br>EQATFTLPDAIEHPLWIRYESPGGTNLN<br>LFKLEEKQKKNYYVTLSKIIWPSEEKWI<br>EKENIEIPLAPSIQFNRQIKLKQHVKGK<br>QEISFSDYSSRISLDGVLGGSRIQFNRK<br>YIKNHKELLGEGDIGPVFFNLVVDVAPL<br>QETRNGRLQSPIGKALKVISSDFSKVID<br>YKPKELMDWMNTGSASNSFGVASLLEGM<br>RVMSIDMGQRTSASVSIFEVVKELPKDQ<br>EQKLFYSINDTELFAIHKRSFLLNLPGE<br>VVTKNNKQQRQERRKKRQFVRSQIRMLA<br>NVLRLETKKTPDERKKAIHKLMEIVQSY<br>DSWTASQKEVWEKELNLLTNMAAFNDEI<br>WKESLVELHHRIEPYVGQIVSKWRKGLS<br>EGRKNLAGISMWNIDELEDTRRLLISWS<br>KRSRTPGEANRIETDEPFGSSLLQHIQN<br>VKDDRLKQMANLIIMTALGFKYDKEEKD<br>RYKRWKETYPACQIILFENLNRYLFNLD<br>RSRRENSRLMKWAHRSIPRTVSMQGEMF<br>GLQVGDVRSEYSSRFHAKTGAPGIRCHA<br>LTEEDLKAGSNTLKRLIEDGFINESELA<br>YLKKGDIIPSQGGELFVTLSKRYKKDSD<br>NNELTVIHADINAAQNLQKRFWQQNSEV<br>YRVPCQLARMGEDKLYIPKSQTETIKKY<br>FGKGSFVKNNTEQEVYKWEKSEKMKIKT<br>DTTFDLQDLDGFEDISKTIELAQEQQKK<br>YLTMFRDPSGYFFNNETWRPQKEYWSIV<br>NNIIKSCLKKKILSNKVEL |

TABLE 2-continued

Cas12b orthologues

| Species | Sequence |
|---|---|
| *Lentisphaeria bacterium* (SEQ ID NO: 391) | MAVELNRIYQGRVNFIVYIFDENQNQVS<br>VDNGDDLLFVHHELYQDAINYYLVALAA<br>MALDSKDSLFGKFKMQIRAVWNDFYRNG<br>QLRPGLKHSLIRSLGHAAELNTSNGADI<br>AMNLILEDGGIPSEILNAALEHLAEKCT<br>GDVSQLGKTFFPRFCDTAYHGNWDVDAK<br>SFSEKKGRQRLVDALYSLFLPVQAVQEL<br>APEIEIGWGGVKTQTGKFFTGDEAKASL<br>KKAISYFLQDTGKNSPELQEYFSVAGKQ<br>PLEQYLGKIDTFPEISFGRISSHQNINI<br>SNAMWILKFFPDQYSVDLIKNLIPNKKY<br>EIGIAPQWGDDPVKLSRGKRGYTFRAFT<br>DLAMWEKNWKVFDRAAFSDALKTINQFR<br>NKTQERNDQLKRYCAALNWMDGESSDKK<br>PPVEPADADAVDEAATSVLPILAGDKRW<br>NALLQLQKELGICNDFTENELMDYGLSL<br>RTIRGYQKLRSMMLEKEEKMRAKTADDE<br>EISQALQEIIIKFQSSHRDTIGSVSLFL<br>KLAEPKYFCVWHDADKNQNFASVDMVAD<br>AVRYYSYQEEKARLEEPIQITPADARY<br>SRRVSDLYALVYKNAKECKTGYGLRPDG<br>NFVFEIAQKNAKGYAPAKWLAFSAPRLK<br>RDGLIDKEFSAYYPPVLQAFLREEEAPK<br>QSFKTTAVILMPDWDKNGKRRILLNFPI<br>KLDVSAIHQKTDHRFENQFYFANNTNTC<br>LLWPSYQYKKPVTWYQGKKPFDVVAVDL<br>GQRSAGAVSRITVSTEKREHSVAIGEAG<br>GTQWYAYRKFSGLLRLPGEDATVIRDGQ<br>RTEELSGNAGRLSTEEETVQACVLCKML<br>IGDATLLGGSDEKTIRSFPKQNDKLLIA<br>FRRATGRMKQLQRWLWMLNENGLCDKAK<br>TEISNSDWLVNKNIDNVLKEEKQHREML<br>PAILLQIADRVLPLRGRKWDWVLNPQSN<br>SFVLQQTAHGSGDPHKKICGQRGLSFAR<br>IEQLESLRMRCQALNRILMRKTGEKPAT<br>LAEMRNNPIPDCCPDILMRLDAMKEQRI<br>NQTANLILAQALGLRHCLHSESATKRKE<br>NGMHGEYEKIPGVEPAAFVVLEDLSRYR<br>FSQDRSSYENSRLMKWSHRKILEKLALL<br>CEVFNVPILQVGAAYSSKFSANAIPGFR<br>AEECSIDQLSFYPWRELKDSREKALVEQ<br>IRKIGHRLLTFDAKATIIMPRNGGPVFI<br>PFVPSDSKDTLIQADINASFNIGLRGVA<br>DATNLLCNNRVSCDRKKDCWQVKRSSNF<br>SKMVYPEKLSLSFDPIKKQEGAGGNFFV<br>LGCSERILTGTSEKSPVFTSSEMAKKYP<br>NLMFGSALWRNEILKLERCCKINQSRLD<br>KFIAKKEVQNEL |
| *Laceyella sediminis* (SEQ ID NO: 392) | MSIRSFKLKIKTKSGVNAEELRRGLWRT<br>HQLINDGIAYYMNWLVLLRQEDLFIRNE<br>ETNEIEKRSKEEIQGELLERVHKQQQRN<br>QWSGEVDDQTLLQTLRHLYEEIVPSVIG<br>KSGNASLKARFFLGPLVDPNNKTTKDVS<br>KSGPTPKWKKMKDAGDPNWVQEYEKYMA<br>ERQTLVRLEEMGLIPLFPMYTDEVGDIH<br>WLPQASGYTRTWDRDMFQQAIERLLSWE<br>SWNRRVRERRAQFEKKTHDFASRFSESD<br>VQWMNKLREYEAQQEKSLEENAFAPNEP<br>YALTKKALRGWERVYHSWMRLDSAASEE<br>AYWQEVATCQTAMRGEFGDPAIYQFLAQ<br>KENHDIWRGYPERVIDFAELNHLQRELR<br>RAKEDATFTLPDSVDHPLWVRYEAPGGT<br>NIHGYDLVQDTKRNLTLILDKFILPDEN<br>GSWHEVKKVPFSLAKSKQFHRQVWLQEE<br>QKQKKREVVFYDYSTNLPHLGTLAGAKL<br>QWDRNFLNKRTQQQIEETGEIGKVFFNI<br>SVDVRPAVEVKNGRLQNGLGKALTVLTH<br>PDGTKIVTGWKAEQLEKWVGESGRVSSL<br>GLDSLSEGLRVMSIDLGQRTSATVSVFE<br>ITKEAPDNPYKFFYQLEGTELFAVHQRS<br>FLLALPGENPPQKIKQMREIRWKERNRI<br>KQQVDQLSAILRLHKKVNEDERIQAIDK<br>LLQKVASWQLNEEIATAWNQALSQLYSK<br>AKENDLQWNQAIKNAHHQLEPVVGKQIS |

TABLE 2-continued

Cas12b orthologues

| Species | Sequence |
|---|---|
| | LWRKDLSTGRQGIAGLSLWSIEELEATK<br>KLLTRWSKRSREPGVVKRIERFETFAKQ<br>IQHHINQVKENRLKQLANLIVMTALGYK<br>YDQEQKKWIEVYPACQVVLFENLRSYRF<br>SYERSRRENKKLMEWSHRSIPKLVQMQG<br>ELFGLQVADVYAAYSSRYHGRTGAPGIR<br>CHALTEADLRNETNIIHELIEAGFIKEE<br>HRPYLQQGDLVPWSGGELFATLQKPYDN<br>PRILTLHADINAAQNIQKRFWHPSMWFR<br>VNCESVMEGEIVTYVPKNKTVHKKQGKT<br>FRFVKVEGSDVYEWAKWSKNRNKNTFSS<br>ITERKPPSSMILFRDPSGTFFKEQEWVE<br>QKTFWGKVQSMIQAYMKKTIVQRMEE |

The effector protein may comprise a chimeric effector protein comprising a first fragment from a first effector protein (e.g., a C2c1) ortholog and a second fragment from a second effector (e.g., a C2c1) protein ortholog, and wherein the first and second effector protein orthologs are different. At least one of the first and second effector protein (e.g., a C2c1) orthologs may comprise an effector protein (e.g., a C2c1) from or originates from an organism comprising *Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes, Verrucomicrobiaceae, Lentisphaeria* or *Laceyella*; e.g., a chimeric effector protein comprising a first fragment and a second fragment wherein each of the first and second fragments is selected from a C2c1 of an organism comprising *Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes, Verrucomicrobiaceae, Lentisphaeria* or *Laceyella* wherein the first and second fragments are not from the same bacteria; for instance a chimeric effector protein comprising a first fragment and a second fragment wherein each of the first and second fragments is selected from a C2c1 of *Alicyclobacillus acidoterrestris* (e.g., ATCC 49025), *Alicyclobacillus contaminans* (e.g., DSM 17975), *Alicyclobacillus macrosporangiidus* (e.g., DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1 or genbank accession number WP_031386437), *Elusimicrobia bacterium* RIFOXYA12, *Omnitrophica* WOR_2 bacterium RIFCSPHIGHO2, *Opitutaceae bacterium* TAV5 or genbank accession number WP_009513281, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734 or genbank accession number WP_028326052), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060 or genbank accession number WP_043747912), *Alicyclobacillus kakegawensis* (e.g., genbank accession number WP_067936067), *Bacillus* sp. V3-13 (e.g., genbank accession number WP_101661451), *Lentisphaeria bacterium*

(e.g., from DCFZ01000012), *Laceyella_sediminis* (e.g., genbank accession number WP_106341859), wherein the first and second fragments are not from the same bacteria. As used herein, when a Cas12 protein (e.g., Cas12b) originates from a species, it may be the wild type Cas12 protein in the species, or a homolog of the wild type Cas12 protein in the species. The Cas12 protein that is a homolog of the wild type Cas12 protein in the species may comprise one or more variations (e.g., mutations, truncations, etc.) of the wild type Cas12 protein.

In a more preferred embodiment, the C2c1b is derived or originates from a bacterial species selected from *Alicyclobacillus acidoterrestris* (e.g., ATCC 49025), *Alicyclobacillus contaminans* (e.g., DSM 17975), *Alicyclobacillus macrosporangiidus* (e.g., DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1 or genbank accession number WP_031386437), *Elusimicrobia bacterium* RIFOXYA12, *Omnitrophica* WOR_2 bacterium RIFCSPHIGHO2, *Opitutaceae bacterium* TAV5 or genbank accession number WP_009513281, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734 or genbank accession number WP_028326052), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060 or genbank accession number WP_043747912), *Alicyclobacillus kakegawensis* (e.g., genbank accession number WP_067936067), *Bacillus* sp. V3-13 (e.g., genbank accession number WP_101661451), *Lentisphaeria bacterium* (e.g., from DCFZ01000012), *Laceyella_sediminis* (e.g., genbank accession number WP_106341859). In certain embodiments, the C2c1p is derived from a bacterial species selected from *Alicyclobacillus acidoterrestris* (e.g., ATCC 49025), or *Alicyclobacillus contaminans* (e.g., DSM 17975).

In particular embodiments, the homologue or orthologue of C2c1 as referred to herein has a sequence homology or identity of at least 80%, more preferably at least 85%, even more preferably at least 90%, such as for instance at least 95% with C2c1. In further embodiments, the homologue or orthologue of C2c1 as referred to herein has a sequence identity of at least 80%, more preferably at least 85%, even more preferably at least 90%, such as for instance at least 95% with the wild type C2c1. Where the C2c1 has one or more mutations (mutated), the homologue or orthologue of said C2c1 as referred to herein has a sequence identity of at least 80%, more preferably at least 85%, even more preferably at least 90%, such as for instance at least 95% with the mutated C2c1.

In an embodiment, the C2c1 protein may be an ortholog of an organism of a genus which includes, but is not limited to, *Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes, Verrucomicrobiaceae, Lentisphaeria* or *Laceyella*; in particular embodiments, the type V Cas protein may be an ortholog of an organism of a species which includes, but is not limited to, *Alicyclobacillus acidoterrestris* (e.g., ATCC 49025), *Alicyclobacillus contaminans* (e.g., DSM 17975), *Alicyclobacillus macrosporangiidus* (e.g., DSM 17980), *Bacillus hisashii* strain C4, *Candidatus* Lindowbacteria bacterium RIFCSPLOWO2, *Desulfovibrio inopinatus* (e.g., DSM 10711), *Desulfonatronum thiodismutans* (e.g., strain MLF-1 or genbank accession number WP_031386437), *Elusimicrobia bacterium* RIFOXYA12, *Omnitrophica* WOR_2 bacterium RIFCSPHIGHO2, *Opitutaceae bacterium* TAV5 or genbank accession number WP_009513281, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF1112, *Bacillus* sp. NSP2.1, *Desulfatirhabdium butyrativorans* (e.g., DSM 18734 or genbank accession number WP_028326052), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060 or genbank accession number WP_043747912), *Alicyclobacillus kakegawensis* (e.g., genbank accession number WP_067936067), *Bacillus* sp. V3-13 (e.g., genbank accession number WP_101661451), *Lentisphaeria bacterium* (e.g., from DCFZ01000012), *Laceyella sediminis* (e.g., Genbank accession number WP_106341859), or *Bacillus* sp. V3-13 (e.g., GenBank accession number WP_101661451). In particular embodiments, the homologue or orthologue of C2c1 as referred to herein has a sequence homology or identity of at least 80%, more preferably at least 85%, even more preferably at least 90%, such as for instance at least 95% with one or more of the C2c1 sequences disclosed herein. In further embodiments, the homologue or orthologue of C2c1 as referred to herein has a sequence identity of at least 80%, more preferably at least 85%, even more preferably at least 90%, such as for instance at least 95% with the wild type AacC2c1 or BthC2c1.

In particular embodiments, the C2c1 protein of the invention has a sequence homology or identity of at least 60%, more particularly at least 70%, such as at least 80%, more preferably at least 85%, even more preferably at least 90%, such as for instance at least 95% with AacC2c1 or BthC2c1. In further embodiments, the C2c1 protein as referred to herein has a sequence identity of at least 60%, such as at least 70%, more particularly at least 80%, more preferably at least 85%, even more preferably at least 90%, such as for instance at least 95% with the wild type AacC2c1. In particular embodiments, the C2c1 protein of the present invention has less than 60% sequence identity with AacC2c1. The skilled person will understand that this includes truncated forms of the C2c1 protein whereby the sequence identity is determined over the length of the truncated form.

In certain example embodiments, a Cas12b ortholog may have an activity (e.g., nucleic acids (such as RNA or DNA) cleavage activity) at a temperature, e.g., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., about 40° C., about 41° C., about 42° C., about 43° C., about 44° C., about 45° C., about 46° C., about 47° C., about 48° C., about 49° C., or about 50° C. A given Cas12b ortholog may have its optimal activity at a range of temperature, e.g., from 30° C. to 50° C., from 30° C. to 48° C., from 37° C. to 42° C., or from 37° C. to 48° C. In some examples, BvCas12b may have an activity at about 37° C. In some examples, BhCas12b (e.g., variant 4 disclosed herein) may have an activity at about 37° C. In some examples, AkCas12b may have an activity at about 48° C. The activity may be the activity of the Cas12b ortholog in an eukaryotic cell. Alternatively or additionally, the activity may be the activity of the ortholog in a prokaryotic cell. In some cases, such an activity may be an optimal activity.

Modified C2c1 Enzymes

In particular embodiments, it is of interest to make use of an engineered C2c1 protein as defined herein, such as C2c1, wherein the protein complexes with a nucleic acid molecule comprising RNA to form a CRISPR complex, wherein when in the CRISPR complex, the nucleic acid molecule targets one or more target polynucleotide loci, the protein comprises at least one modification compared to unmodified C2c1 protein, and wherein the CRISPR complex comprising the modified protein has altered activity as compared to the complex comprising the unmodified C2c1 protein. It is to be understood that when referring herein to CRISPR "protein", the C2c1 protein preferably is a modified CRISPR enzyme, e.g., having increased or decreased (or no) enzymatic activity, such as without limitation including C2c1. The term "CRISPR protein" may be used interchangeably with "CRISPR enzyme", irrespective of whether the CRISPR protein has altered enzymatic activity, such as increased or decreased (or no) enzymatic activity, compared to the wild type CRISPR protein.

In addition to the mutations described above, the CRISPR-Cas protein may be additionally modified. As used herein, the term "modified" with regard to a CRISPR-Cas protein generally refers to a CRISPR-Cas protein having one or more modifications or mutations (including point mutations, truncations, insertions, deletions, chimeras, fusion proteins, etc.) compared to the wild type Cas protein from which it is derived. By derived is meant that the derived enzyme is largely based, in the sense of having a high degree of sequence homology with, a wildtype enzyme, but that it has been mutated (modified) in some way as known in the art or as described herein.

The additional modifications of the CRISPR-Cas protein may or may not cause an altered functionality. By means of example, and in particular with reference to CRISPR-Cas protein, modifications which do not result in an altered functionality include for instance codon optimization for expression into a particular host, or providing the nuclease with a particular marker (e.g., for visualization). Modifications that may result in altered functionality may also include mutations, including point mutations, insertions, deletions, truncations (including split nucleases), etc. Fusion proteins may without limitation include for instance fusions with heterologous domains or functional domains (e.g., localization signals, catalytic domains, etc.). In certain embodiments, various different modifications may be combined (e.g., a mutated nuclease which is catalytically inactive and which further is fused to a functional domain, such as for instance to induce DNA methylation or another nucleic acid modification, such as including without limitation a break (e.g., by a different nuclease (domain)), a mutation, a deletion, an insertion, a replacement, a ligation, a digestion, a break or a recombination). As used herein, "altered functionality" includes without limitation an altered specificity (e.g., altered target recognition, increased (e.g., "enhanced" Cas proteins) or decreased specificity, or altered PAM recognition), altered activity (e.g., increased or decreased catalytic activity, including catalytically inactive nucleases or nickases), and/or altered stability (e.g., fusions with destabilization domains). Suitable heterologous domains include without limitation a nuclease, a ligase, a repair protein, a methyltransferase, (viral) integrase, a recombinase, a transposase, an argonaute, a cytidine deaminase, a retron, a group II intron, a phosphatase, a phosphorylase, a sulpfurylase, a kinase, a polymerase, an exonuclease, etc. Examples of all these modifications are known in the art. It will be understood that a "modified" nuclease as referred to herein, and in particular a "modified" Cas or "modified" CRISPR-Cas system or complex preferably still has the capacity to interact with or bind to the polynucleic acid (e.g., in complex with the guide molecule). Such modified Cas protein can be combined with the deaminase protein or active domain thereof as described herein.

In certain embodiments, CRISPR-Cas protein may comprise one or more modifications resulting in enhanced activity and/or specificity, such as including mutating residues that stabilize the targeted or non-targeted strand (e.g., eCas9; "Rationally engineered Cas9 nucleases with improved specificity", Slaymaker et al. (2016), Science, 351(6268): 84-88, incorporated herewith in its entirety by reference). In certain embodiments, the altered or modified activity of the engineered CRISPR protein comprises increased targeting efficiency or decreased off-target binding. In certain embodiments, the altered activity of the engineered CRISPR protein comprises modified cleavage activity. In certain embodiments, the altered activity comprises increased cleavage activity as to the target polynucleotide loci. In certain embodiments, the altered activity comprises decreased cleavage activity as to the target polynucleotide loci. In certain embodiments, the altered activity comprises decreased cleavage activity as to off-target polynucleotide loci. In certain embodiments, the altered or modified activity of the modified nuclease comprises altered helicase kinetics. In certain embodiments, the modified nuclease comprises a modification that alters association of the protein with the nucleic acid molecule comprising RNA (in the case of a Cas protein), or a strand of the target polynucleotide loci, or a strand of off-target polynucleotide loci. In an aspect of the invention, the engineered CRISPR protein comprises a modification that alters formation of the CRISPR complex. In certain embodiments, the altered activity comprises increased cleavage activity as to off-target polynucleotide loci. Accordingly, in certain embodiments, there is increased specificity for target polynucleotide loci as compared to off-target polynucleotide loci. In other embodiments, there is reduced specificity for target polynucleotide loci as compared to off-target polynucleotide loci. In certain embodiments, the mutations result in decreased off-target effects (e.g., cleavage or binding properties, activity, or kinetics), such as in case for Cas proteins for instance resulting in a lower tolerance for mismatches between target and guide RNA. Other mutations may lead to increased off-target effects (e.g., cleavage or binding properties, activity, or kinetics). Other mutations may lead to increased or decreased on-target effects (e.g., cleavage or binding properties, activity, or kinetics). In certain embodiments, the mutations result in altered (e.g., increased or decreased) helicase activity, association or formation of the functional nuclease complex (e.g., CRISPR-Cas complex). In certain embodiments, as described above, the mutations result in an altered PAM recognition, i.e., a different PAM may be (in addition or in the alternative) recognized, compared to the unmodified Cas protein. Particularly preferred mutations include positively charged residues and/or (evolutionary) conserved residues, such as conserved positively charged residues, in order to enhance specificity. In certain embodiments, such residues may be mutated to uncharged residues, such as alanine.

The crystal structure of C2c1 reveals similarity with another Type V Cas protein, Cpf1 (also known as Cas12a).

Both C2c1 and Cpf1 consist of an α-helical recognition lobe (REC) and a nuclease lobe (NUC). The NUC lobe further contains an oligonucleotide-binding (WED/OBD) domain, a RuvC domain, a Nuc domain, and a bridge helix (BH), with structural shuffling and folding to form the intact 3D C2c1 structure (Liu et al. Mol. Cell 65, 310-322). Certain mutations (e.g., R1226A in AsCpf1, R894A in BvCas12b) in the Nuc domain render Cpf1 into a nickase for non-target strand cleavage. Mutations of the catalytic residues (e.g., mutations at D908, E933, D1263 of AsCpf1) in the RuvC domain abolish catalytic activity of Cpf1 as a nuclease. Further, mutations in the PAM interaction (PI) domain of Cpf1 (e.g., mutations at S542, K548, N522, and K607 of AsCpf1), have been shown to alter Cpf1 specificities, potentially increasing or reducing off-target cleavage (See Gao et al. Cell Research (2016) 26, 901-913 (2016); Gao et al. Nature Biotechnology 35, 789-792 (2017)). The crystal structure of C2c1 also reveals that C2c1 lacks an identifiable PI domain; rather, it is suggested that C2c1 undergoes conformation adjustment to accommodate the binding of the PAM proximal double stranded DNA for PAM recognition and R-loop formation; C2c1 likely engages the WED/OBD and alpha helix domain to recognize the PAM duplex from both the major and the minor groove sides (Yang et al, Cell 167, 1814-1828 (2016)).

According to the invention, mutants can be generated which lead to inactivation of the enzyme or that modify the double strand nuclease to nickase activity, or which alter the PAM recognition specificity of C2c1. In certain embodiments, this information is used to develop enzymes with reduced off-target effects.

In certain example embodiments, the editing preference is for a specific insert or deletion within the target region. In certain example embodiments, the at least one modification increases formation of one or more specific indels. In certain example embodiments, the at least one modification is in a C-terminal RuvC like domain, the NUC domain, the N-terminal alpha-helical region, the mixed alpha and beta region, or a combination thereof. In certain example embodiments, the altered editing preference is indel formation. In certain example embodiments, the at least one modification increases formation of one or more specific insertions.

In certain example embodiments, the at least one modification increases formation of one or more specific insertions. In certain example embodiments, the at least one modification results in an insertion of an A adjacent to an A, T, G, or C in the target region. In another example embodiment, the at least one modification results in insertion of a T adjacent to an A, T, G, or C in the target region. In another example embodiment, the at least one modification results in insertion of a G adjacent to an A, T, G, or C in the target region. In another example embodiment, the at least one modification results in insertion of a C adjacent to an A, T, C, or G in the target region. The insertion may be 5' or 3' to the adjacent nucleotide. In one example embodiment, the one or more modification results in direct insertion of a T adjacent to an existing T. In certain example embodiments, the existing T corresponds to the 4th position in the binding region of a guide sequence. In certain example embodiments, the one or more modifications result in an enzyme which ensures more precise one-base insertions or deletions, such as those described above. More particularly, the one or more modifications may reduce the formations of other types of indels by the enzyme. The ability to generate one-base insertions or deletions can be of interest in a number of applications, such as correction of genetic mutants in diseases caused by small deletions, more particularly where HDR is not possible. For example, correction of the F508del mutation in CFTR via delivery of three sRNA directing insertion of three T's, which is the most common genotype of cystic fibrosis, or correction of Alia Jafar's single nucleotide deletion in CDKL5 in the brain. As the editing method only requires NHEJ, the editing would be possible in post-mitotic cells such as the brain. The ability to generate one base pair insertions/deletions may also be useful in genome-wide CRISPR-Cas negative selection screens. In certain example embodiments, the at least one modification is a mutation. In certain other example embodiments, the one or more modification may be combined with one or more additional modifications or mutations described below including modifications to increase binding specificity and/or decrease off-target effects.

In certain example embodiments, the engineered CRISPR-cas effector comprising at least one modification that alters editing preference as compared to wild type may further comprise one or more additional modifications that alters the binding property as to the nucleic acid molecule comprising RNA or the target polypeptide loci, alters binding kinetics as to the nucleic acid molecule or target molecule or target polynucleotide, or alters binding specificity as to the nucleic acid molecule. Example of such modifications are summarized in the following paragraph. Based on the above information, mutants can be generated which lead to inactivation of the enzyme or which modify the double strand nuclease to nickase activity. In alternative embodiments, this information is used to develop enzymes with reduced off-target effects.

Modified Nickases

Mutations can also be made at neighboring residues at amino acids that participate in the nuclease activity. In some embodiments, only the RuvC domain is inactivated, and in other embodiments, another putative nuclease domain is inactivated, wherein the effector protein complex functions as a nickase and cleaves only one DNA strand. In some embodiments, two C2c1 variants (each a different nickase) are used to increase specificity and two nickase variants are used to cleave DNA at a target (where both nickases cleave a DNA strand, while minimizing or eliminating off-target modifications where only one DNA strand is cleaved and subsequently repaired). In preferred embodiments, the C2c1 effector protein cleaves sequences associated with or at a target locus of interest as a homodimer comprising two C2c1 effector protein molecules. In a preferred embodiment, the homodimer may comprise two C2c1 effector protein molecules comprising a different mutation in their respective RuvC domains.

The invention contemplates methods of using two or more nickases, in particular a dual or double nickase approach. In some aspects and embodiments, a single type C2c1 nickase may be delivered, for example a modified C2c1 or a modified C2c1 nickase as described herein. This results in the target DNA being bound by two C2c1 nickases. In addition, it is also envisaged that different orthologs may be used, e.g., an C2c1 nickase on one strand (e.g., the coding strand) of the DNA and an ortholog on the non-coding or opposite DNA strand. The ortholog can be, but is not limited to, a Cas9 nickase such as a SaCas9 nickase or a SpCas9 nickase. It may be advantageous to use two different orthologs that require different PAMs and may also have different guide requirements, thus allowing a greater deal of control for the user. In certain embodiments, DNA cleavage will involve at least four types of nickases, wherein each type is guided to a different sequence of target DNA, wherein each pair introduces a first nick into one DNA strand and the second introduces a nick into the second DNA strand. In such methods, at least two pairs of single stranded breaks are introduced into the target DNA wherein upon introduction of first and second pairs of single-strand breaks, target sequences between the first and second pairs of single-strand breaks are excised. In certain embodiments, one or both of the orthologs is controllable, i.e., inducible.

In certain methods according to the present invention, the CRISPR-Cas protein is preferably mutated with respect to a corresponding wild-type enzyme such that the mutated CRISPR-Cas protein lacks the ability to cleave one or both DNA strands of a target locus containing a target sequence. In particular embodiments, one or more catalytic domains of the C2c1 protein are mutated to produce a mutated Cas protein which cleaves only one DNA strand of a target sequence.

In certain embodiments of the methods provided herein, the CRISPR-Cas protein is a mutated CRISPR-Cas protein which cleaves only one DNA strand, i.e., a nickase. More particularly, in the context of the present invention, the nickase ensures cleavage within the non-target sequence, i.e., the sequence which is on the opposite DNA strand of the target sequence and which is 3' of the PAM sequence. By means of further guidance, and without limitation, an arginine-to-alanine substitution (R911A) in the Nuc domain of C2c1 from *Alicyclobacillus acidoterrestris* converts C2c1 from a nuclease that cleaves both strands to a nickase (cleaves a single strand). It will be understood by the skilled person that where the enzyme is not AacC2c1, a mutation may be made at a residue in a corresponding position.

In certain embodiments, the C2c1 protein is a C2c1 nickase which comprises a mutation in the Nuc domain. In some embodiments, the C2c1 nickase comprises a mutation corresponding to amino acid positions R911, R1000, or R1015 in *Alicyclobacillus acidoterrestris* C2c1. In some embodiments, the C2c1 nickase comprises a mutation corresponding to R911A, R1000A, or R1015A in *Alicyclobacillus acidoterrestris* C2c1. In some embodiments, the C2c1 nickase comprises a mutation corresponding to R894A in *Bacillus* sp. V3-13 C2c1. In certain embodiments, the C2c1 protein recognizes PAMs with increased or decreased specificity as compared with an unmutated or unmodified form of the protein. In some embodiments, the C2c1 protein recognizes altered PAMs as compared with an unmutated or unmodified form of the protein.

Deactivated/Inactivated C2c1 Protein

Where the C2c1 protein has nuclease activity, the protein may be modified to have diminished nuclease activity e.g., nuclease inactivation of at least 70%, at least 80%, at least 90%, at least 95%, at least 97%, or 100% as compared with the wild type enzyme; or to put in another way, a C2c1 enzyme having advantageously about 0% of the nuclease activity of the non-mutated or wild type C2c1 enzyme or CRISPR enzyme, or no more than about 3% or about 5% or about 10% of the nuclease activity of the non-mutated or wild type C2c1 enzyme. In some embodiments, a CRISPR-Cas protein is considered to substantially lack all DNA cleavage activity when the DNA cleavage activity of the mutated enzyme is about no more than 25%, 10%, 5%, 1%, 0.1%, 0.01%, or less of the DNA cleavage activity of the non-mutated form of the enzyme; an example can be when the DNA cleavage activity of the mutated form is nil or negligible as compared with the non-mutated form. In these embodiments, the CRISPR-Cas protein is used as a generic DNA binding protein. This is possible by introducing mutations into the nuclease domains of the C2c1 and orthologs thereof.

In certain embodiments, the CRISPR enzyme is engineered and can comprise one or more mutations that reduce or eliminate a nuclease activity.

In certain embodiments, the C2c1 protein is a catalytically inactive C2c1 which comprises a mutation in the RuvC domain. In some embodiments, the catalytically inactive C2c1 protein comprises a mutation corresponding to amino acid positions D570, E848, or D977 in *Alicyclobacillus acidoterrestris* C2c1. In some embodiments, the catalytically inactive C2c1 protein comprises a mutation corresponding to D570A, E848A, or D977A in *Alicyclobacillus acidoterrestris* C2c1.

In some embodiments, the catalytically inactive C2c1 protein comprises a mutation corresponding to amino acid positions D574, E828, or D952 in *Bacillus hisashii* C2c1. In some embodiments, the catalytically inactive C2c1 protein comprises a mutation corresponding to D574A, E828A, or D952A in *Bacillus hisashii* C2c1.

In some embodiments, the catalytically inactive C2c1 protein comprises a mutation corresponding to amino acid positions D567, E831, or D963 in *Bacillus* sp. V3-13 C2c1. In some embodiments, the catalytically inactive C2c1 protein comprises a mutation corresponding to D567A, E831A, or D963A in *Bacillus* sp. V3-13 C2c1.

In certain embodiments, the C2c1 protein is a catalytically inactive C2c1 which comprises a mutation in the RuvC domain. In some embodiments, the catalytically inactive C2c1 protein comprises a mutation corresponding to amino acid positions D570, E848, or D977 in *Alicyclobacillus acidoterrestris* C2c1. In some embodiments, the catalytically inactive C2c1 protein comprises a mutation corresponding to D570A, E848A, or D977A in *Alicyclobacillus acidoterrestris* C2c1.

In some embodiments, the catalytically inactive C2c1 protein comprises a mutation corresponding to amino acid positions D574, E828, or D952 in *Bacillus hisashii* C2c1. In some embodiments, the catalytically inactive C2c1 protein comprises a mutation corresponding to D574A, E828A, or D952A in *Bacillus hisashii* C2c1.

In some embodiments, the catalytically inactive C2c1 protein comprises a mutation corresponding to amino acid positions D567, E831, or D963 in *Bacillus* sp. V3-13 C2c1. In some embodiments, the catalytically inactive C2c1 protein comprises a mutation corresponding to D567A, E831A, or D963A in *Bacillus* sp. V3-13 C2c1.

In certain embodiments, the C2c1 protein is a C2c1 nickase which comprises a mutation in the Nuc domain. In some embodiments, the C2c1 nickase comprises a mutation corresponding to amino acid positions R911, R1000, or R1015 in *Alicyclobacillus acidoterrestris* C2c1. In some embodiments, the C2c1 nickase comprises a mutation corresponding to R911A, R1000A, or R1015A in *Alicyclobacillus acidoterrestris* C2c1. In some embodiments, the C2c1 nickase comprises a mutation corresponding to R894A in *Bacillus* sp. V3-13 C2c1. In certain embodiments, the C2c1 protein recognizes PAMs with increased or decreased specificity as compared with an unmutated or unmodified form of the protein. In some embodiments, the C2c1 protein recognizes altered PAMs as compared with an unmutated or unmodified form of the protein.

In some embodiments, a CRISPR-Cas protein is considered to substantially lack all DNA cleavage activity when the DNA cleavage activity of the mutated enzyme is about no more than 25%, 10%, 5%, 1%, 0.1%, 0.01%, or less of the DNA cleavage activity of the non-mutated form of the enzyme; an example can be when the DNA cleavage activity of the mutated form is nil or negligible as compared with the non-mutated form. In these embodiments, the CRISPR-Cas protein is used as a generic DNA binding protein. The mutations may be artificially introduced mutations or gain- or loss-of-function mutations.

In addition to the mutations described above, the CRISPR-Cas protein may be additionally modified. As used herein, the term "modified" with regard to a CRISPR-Cas protein generally refers to a CRISPR-Cas protein having one or more modifications or mutations (including point mutations, truncations, insertions, deletions, chimeras, fusion proteins, etc.) compared to the wild type Cas protein from which it is derived. By derived is meant that the derived enzyme is largely based, in the sense of having a high degree of sequence homology with, a wildtype enzyme, but that it has been mutated (modified) in some way as known in the art or as described herein.

The inactivated C2c1 CRISPR enzyme may have associated (e.g., via fusion protein or suitable linkers) one or more functional domains, including for example, one or more domains from the group comprising, consisting essentially of, or consisting of deaminase activity, methylase activity, demethylase activity, transcription activation activity, transcription repression activity, transcription release factor activity, histone modification activity, RNA cleavage activity, DNA cleavage activity, nucleic acid binding activity, and molecular switches (e.g., light inducible). Suitable linkers for use in the methods of the present invention are well known to those of skill in the art and include, but are not limited to, straight or branched-chain carbon linkers, heterocyclic carbon linkers, or peptide linkers. However, as used herein the linker may also be a covalent bond (carbon-carbon bond or carbon-heteroatom bond). In particular embodiments, the linker is used to separate the targeting domain and the adenosine deaminase by a distance sufficient to ensure that each protein retains its required functional property. Preferred peptide linker sequences adopt a flexible extended conformation and do not exhibit a propensity for developing an ordered secondary structure. In certain embodiments, the linker can be a chemical moiety which can be monomeric, dimeric, multimeric or polymeric. Preferably, the linker comprises amino acids. Typical amino acids in flexible linkers include Gly, Asn and Ser. Accordingly, in particular embodiments, the linker comprises a combination of one or more of Gly, Asn and Ser amino acids. Other near neutral amino acids, such as Thr and Ala, also may be used in the linker sequence. Exemplary linkers are disclosed in Maratea et al. (1985), Gene 40: 39-46; Murphy et al. (1986) Proc. Nat'l. Acad. Sci. USA 83: 8258-62; U.S. Pat. Nos. 4,935,233; and 4,751,180. For example, GlySer linkers GGS, GGGS (SEQ ID NO: 402) or GSG can be used. GGS, GSG, GGGS (SEQ ID NO: 402) or GGGGS (SEQ ID NO: 403) linkers can be used in repeats of 3 (such as (GGS)3 (SEQ ID NO: 404), (GGGGS)3 (SEQ ID NO: 393) or 5 (SEQ ID NO: 405), 6 (SEQ ID NO: 394), 7 (SEQ ID NO: 406), 9 (SEQ ID NO: 395) or even 12 (SEQ ID NO: 396) or more, to provide suitable lengths. In particular embodiments, linkers such as (GGGGS)3 are preferably used herein. (GGGGS)6 (GGGGS)9 or (GGGGS)12 may preferably be used as alternatives. Other preferred alternatives are (GGGGS)1 (SEQ ID NO:403), (GGGGS)2 (SEQ ID NO: 407), (GGGGS)4 (SEQ ID NO: 408), (GGGGS)5 (SEQ ID NO: 405), (GGGGS)7 (SEQ ID NO: 406), (GGGGS)8 (SEQ ID NO: 409), (GGGGS)10 (SEQ ID NO: 410), or (GGGGS) 11 (SEQ ID NO: 411). In yet a further embodiment, LEPGEKPYKCPECGKSFSQSGALTRHQRTHTR (SEQ ID NO: 412) is used as a linker. In yet an additional embodiment, the linker is XTEN linker. In addition, N- and C-terminal NLSs can also function as linker (e.g., PKKKRKVEASSPKKRKVEAS (SEQ ID NO: 413).

Examples of linkers are shown in the table below.

| | |
|---|---|
| GGS | GGTGGTAGT (SEQ ID NO: 414) |
| GGSx3 (9) | GGTGGTAGTGGAGGGAGCGGCGGT TCA (SEQ ID NO: 415) |
| GGSx7 (21) | ggtggaggaggctctggtggaggcg gtagcggaggcggagggtcgGGTG GTAGTGGAGGGAGCGGCGGTTCA (SEQ ID NO: 416) |
| XTEN | TCGGGATCTGAGACGCCTGGGACCT CGGAATCGGCTACGCCCGAA AGT (SEQ ID NO: 417) |
| Z-EGFR_Short | Gtggataacaaatttaacaaagaaat gtgggcggcgtgggaagaaattcgta acctgccgaacctgaacggctggcag atgaccgcgtttattgcgagcctggt ggatgatccgagccagagcgcgaacc tgctggcggaagcgaaaaaactgaac gatgcgcaggcgccgaaaaccggcgg tggttctggt (SEQ ID NO: 418) |
| GSAT | Ggtggttctgccggtggctccggttc tggctccagcggtggcagctctggtg cgtccggcacgggtactgcgggtggc actggcagcggttccggtactggctc tggc (SEQ ID NO: 419) |

Exemplary functional domains are adenosine deaminase domain containing (ADAD) family members, Fok1, VP64, P65, HSF1, MyoD1. In the event that deaminase is provided, it is advantageous that a guide sequence is designed to introduce one or more mismatches in an RNA duplex or an RNA/DNA heteroduplex formed between the guide sequence and the target sequence. In particular embodiments, the duplex between the guide sequence and the target sequence comprises an A-C mismatch. In the event that Fok1 is provided, it is advantageous that multiple Fok1 functional domains are provided to allow for a functional dimer and that gRNAs are designed to provide proper spacing for functional use (Fok1) as specifically described in Tsai et al. Nature Biotechnology, Vol. 32, Number 6, June 2014. The adaptor protein may utilize known linkers to attach such functional domains. In some cases, it is advantageous that additionally at least one NLS is provided. In some instances, it is advantageous to position the NLS at the N terminus. When more than one functional domain is included, the functional domains may be the same or different.

In general, the positioning of the one or more functional domain on the inactivated C2c1 enzyme is one which allows for correct spatial orientation for the functional domain to affect the target with the attributed functional effect. For example, if the functional domain is a transcription activator (e.g., VP64 or p65), the transcription activator is placed in a spatial orientation which allows it to affect the transcription of the target. Likewise, a transcription repressor will be advantageously positioned to affect the transcription of the target, and a nuclease (e.g., Fok1) will be advantageously positioned to cleave or partially cleave the target. This may include positions other than the N-/C-terminus of the CRISPR enzyme. The functional domain modifies transcription or translation of the target DNA sequence.

In some embodiments, the Cas12b effector protein is associated with one or more functional domains; and the Cas12b effector protein contains one or more mutations within a RuvC and/or Nuc domain, whereby the formed CRISPR complex is capable of delivering an epigenetic modifier or a transcriptional or translational activation or repression signal.

In certain embodiments, the CRISPR-Cas system disclosed herein is a self-inactivating system and the Cas effector protein is transiently expressed. In some embodiments, the self-inactivating system comprises a viral vector such as an AAV vector. In some embodiments, the self-inactivating system comprises DNA sequences that share 80%, 81%, 82%, 83%, 84%, 85%, 86%, 87%, 88%, 89%, 90%, 91%, 92%, 93%, 94%, 95%, 96%, 97%, 98%, 99%, or 100% of identity with the endogenous target sequence. In some embodiments, the self-inactivating system comprises two or more vector systems. In some embodiments, the self-inactivating system comprises a single vector. In some embodiments, the self-inactivating system comprises a Cas effector protein that simultaneously targets the endogenous DNA target sequence and the vector sequence that encodes the Cas effector protein. In some embodiments, the self-inactivating system comprises a Cas effector protein that targets the endogenous DNA target sequence and the vector sequence that encodes the Cas effector protein sequentially. In some embodiments, the nucleotide encoding the Cas effector and the guide sequence are operably linked to separate regulatory elements on a single vector. In some embodiments, the nucleotide encoding the Cas effector and the guide sequence are operably linked to separate regulatory elements on separate vectors. In some embodiments, the regulatory elements are constitutive. In some embodiments, the regulatory elements are inducible.

Destabilized C2c1

In certain embodiments, the effector protein (CRISPR enzyme; C2c1) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e., the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e., the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-C2c1. It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use Glycine Serine linkers as short as GS up to (GGGGS)3 (SEQ ID NO: 393).

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, a temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7. This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme and its stability can be regulated or perturbed using a ligand, whereby the CRISPR enzyme has a DD. Another DD can be a 12-kDa (107-amino-acid) tag based on a mutated FKBP protein, stabilized by Shield1 ligand; see, e.g., Nature Methods 5, (2008). For instance, a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398-all of which are incorporated herein by reference and may be employed in the practice of the invention in selecting a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled-turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses, the system is inducible. In some other senses, the system repressed in the absence of stabilizing ligand and de-repressed in the presence of stabilizing ligand.

Split Designs

C2c1 is also capable of is capable of robust nucleic acid detection. In certain embodiments, C2c1 is converted to a nucleic acid binding protein ("dead C2c1"; dC2c1) by inactivation of its nuclease activity. When converted to a nucleic acid binding protein, C2c1 is useful for localizing other functional components to target nucleic acids in a sequence dependent manner. The components can be natural or synthetic. According to the invention, dC2c1 is used to (i) bring effector modules to specific nucleic acids to modulate the function or transcription, which could be used for large-scale screening, construction of synthetic regulatory circuits and other purposes; (ii) fluorescently tag specific nucleic acids to visualize their trafficking and/or localization; (iii) alter nucleic acid localization through domains with affinity for specific subcellular compartments; and (iv) capture specific nucleic acids (through direct pull down of dC2c2 or use of dC2c2 to localize biotin ligase activity) to enrich for proximal molecular partners, including RNAs and proteins. dC2c1 can be used to i) organize components of a cell, ii) switch components or activities of a cell on or off, and iii) control cellular states based on the presence or amount of a specific transcript present in a cell. In exemplary embodiments, the invention provides split enzymes and reporter molecules, portions of which are provided in hybrid molecules comprising a nucleic acid-binding CRISPR effector, such as, but not limited to, C2c1. When brought into proximity in the presence of a nucleic acid in a cell, activity of the split reporter or enzyme is reconstituted and the activity can then be measured. A split enzyme reconstituted in such manner can detectably act on a cellular component and/or pathway, including, but not limited to, an endogenous component or pathway, or exogenous component or pathway. A split reporter reconstituted in such manner can provide a detectable signal, such as, but not limited to, fluorescent or other detectable moiety. In certain embodiments, a split proteolytic enzyme is provided which when reconstituted acts on one or more components (endogenous or exogenous) in a detectable manner. In one exemplary embodiment, there is provided a method of inducing programmed cell death upon detection of a nucleic acid species in a cell. It will be apparent how such a method could be used to ablate populations of cells, based for example, on the presence of virus in the cells.

According to the invention, there is provided a method of inducing cell death in a cell which contains a nucleic acid of interest, which comprises contacting the nucleic acid in the cell with a composition which comprises a first CRIPSR protein linked to an inactive first portion of a proteolytic enzyme capable of inducing cell death, a second CRISPR protein linked to the complementary portion of the enzyme wherein the enzyme activity of the proteolytic enzyme is reconstituted when the first portion and the complementary portion of the protein are contacted, and a first guide that binds to the first CRISPR protein and hybridizes to a first target sequence of the nucleic acid, and a second guide that binds to the second CRISPR protein and hybridizes to a second target sequence of the nucleic acid. When the target nucleic acid of interest is present, the first and second portions of the proteolytic enzyme are contacted and the proteolytic activity of the enzyme is reconstituted and induces cell death. In one such embodiment of the invention, the proteolytic enzyme is a caspase. In another such embodiment, the proteolytic enzyme is TEV protease, wherein when the proteolytic activity of the TEV protease is reconstituted, a TEV protease substrate is cleaved and/or activated. In an embodiment of the invention, the TEV protease substrate is an engineered procaspase such that when the TEV protease is reconstituted, the procaspase is cleaved and activated, whereby apoptosis occurs. In an embodiment of the invention, a proteolytically cleavable transcription factor can be combined with any downstream reporter gene of choice to yield 'transcription-coupled' reporter systems. In an embodiment, a split protease is used to cleave or expose a degron from a detectable substrate.

According to the invention, there is provided a method of marking or identifying a cell which contains an nucleic acid of interest, which comprises contacting the nucleic acid in the cell with a composition which comprises a first CRIPSR protein linked to an inactive first portion of a proteolytic enzyme, a second CRISPR protein linked to the complementary portion of the enzyme wherein the enzyme activity of the proteolytic enzyme is reconstituted when the first portion and the complementary portion of the protein are contacted, a first guide that binds to the first CRISPR protein and hybridizes to a first target sequence of the nucleic acid, a second guide that binds to the second CRISPR protein and hybridizes to a second target sequence of the nucleic acid, and an indicator which is detectably cleaved by the reconstituted proteolytic enzyme. The first and second portions of the proteolytic enzyme are contacted when the nucleic acid of interest is present in the cell, whereby the activity of the proteolytic enzyme is reconstituted and the indicator is detectably cleaved. In one such embodiment, the detectable indicator is a fluorescent protein, such as, but not limited to, green fluorescent protein. In another such embodiment of the invention, the detectable indicator is a luminescent protein, such as, but not limited to, luciferase. In an embodiment, the split reporter is based on reconstitution of split fragments of *Renilla reniformis* luciferase (Rluc). In an embodiment of the invention, the split reporter is based on complementation between two nonfluorescent fragments of the yellow fluorescent protein (YFP).

Transcription and Modulation

In one aspect, the invention provides a method of identifying, measuring, and/or modulating the state of a cell or tissue based on the presence or level of a particular nucleic acid in the cell or tissue. In one embodiment, the invention provides a CRISPR-based control system designed to modulate the presence and/or activity of a cellular system or component, which may be a natural or synthetic system or component, based on the presence of a selected nucleic acid species of interest. In general, the control system features an inactivated protein, enzyme or activity that is reconstituted when a selected nucleic acid species of interest is present. In an embodiment of the invention, reconstituting an inactivated protein, enzyme or activity involves bringing together inactive components to assemble an active complex.

Split Apoptosis Constructs

It is often desirable to deplete or kill cells based on the presence of aberrant endogenous or foreign DNA, either for basic biology applications to study the role of specific cells types or for therapeutic applications such as cancer or infected cell clearance (Baker, D. J., Childs, B. G., Durik, M., Wijers, M. E., Sieben, C. J., Zhong, J., Saltness, R. A., Jeganathan, K. B., Verzosa, G. C., Pezeshki, A., et al. (2016). Naturally occurring p16(Ink4a)-positive cells shorten healthy lifespan. Nature 530, 184-189.). This targeted cell killing can be achieved by fusing split apoptotic domains to C2c1 proteins, which upon binding to the DNA are reconstituted, leading to death of cells specifically expressing targeted genes or sets of genes. In certain embodiments, the apoptotic domains may be split Caspase 3 (Chelur, D. S., and Chalfie, M. (2007). Targeted cell killing by reconstituted caspases. Proc. Natl. Acad. Sci. U.S.A 104, 2283-2288.). Other possibilities are the assembly of Caspases, such as bringing two Caspase 8 (Pajvani, U. B., Trujillo, M. E., Combs, T. P., Iyengar, P., Jelicks, L., Roth, K. A., Kitsis, R. N., and Scherer, P. E. (2005). Fat apoptosis through targeted activation of caspase 8: a new mouse model of inducible and reversible lipoatrophy. Nat. Med. 11, 797-803.) or Caspase 9 (Straathof, K. C., Pule, M. A., Yotnda, P., Dotti, G., Vanin, E. F., Brenner, M. K., Heslop, H. E., Spencer, D. M., and Rooney, C. M. (2005). An inducible caspase 9 safety switch for T-cell therapy. Blood 105, 4247-4254.) effectors in proximity via C2c1 binding. It is also possible to reconstitute a split TEV (Gray, D. C., Mahrus, S., and Wells, J. A. (2010). Activation of specific apoptotic caspases with an engineered small-molecule-activated protease. Cell 142, 637-646.) via C2c1 binding on a transcript. This split TEV can be used in a variety of readouts, including luminescent and fluorescent readouts (Wehr, M. C., Laage, R., Bolz, U., Fischer, T. M., Grunewald, S., Scheek, S., Bach, A., Nave, K.-A., and Rossner, M. J. (2006). Monitoring regulated protein-protein interactions using split TEV. Nat. Methods 3, 985-993.). One embodiment involves the reconstitution of this split TEV to cleave modified pro-caspase 3 or pro-caspase 7 (Gray, D. C., Mahrus, S., and Wells, J. A. (2010). Activation of specific apoptotic caspases with an engineered small-molecule-activated protease. Cell 142, 637-646), resulting in cell death.

Inducible apoptosis. According to the invention, guides can be used to locate C2c1 complexes bearing functional domains to induce apoptosis. The C2c1 can be any ortholog. In one embodiment, functional domains are fused at the C-terminus of the protein. The C2c1 is catalytically inactive for example via mutations that knock out nuclease activity. The adaptability of system can be demonstrated by employing various methods of caspase activation, and optimization of guide spacing along a target nucleic acid. Caspase 8 and caspase 9 (aka "initiator" caspases) activity can be induced using C2c1 complex formation to bring together caspase 8 or caspase 9 enzymes associated with C2c1. Alternatively, caspase 3 and caspase 7 (aka "effector" caspases) activity can be induced when C2c1 complexes bearing tobacco etch virus (TEV) N-terminal and C-terminal portions ("snipper") are maintained in proximity, activating the TEV protease activity and leading to cleavage and activation of caspase 3 or caspase 7 pro-proteins. The system can employ split caspase 3, with heterodimerization of the caspase 3 portions by attachment to C2c1 complexes bound to a target nucleic acid. Exemplary apoptotic components are set forth in Table 3 below.

TABLE 3

| Apoptotic Components | | |
|---|---|---|
| iCasp9 (SEQ ID NO: 420) | GFGDVGALESLRGNADLAYI LSMEPCGHCLIINNVNFCRE SGLRTRTGSNIDCEKLRRRF SSLHFMVEVKGDLTAKKMVL ALLELARQDHGALDCCVVVI LSHGCQASHLQFPGAVYGTD GCPVSVEKIVNIFNGTSCPS LGGKPKLFFIQACGGEQKDH GFEVASTSPEDESPGSNPEP DATPFQEGLRTFDQLDAISS | Straathof, K.C., et al. (2005) Blood 105, 4247-4254 |

TABLE 3-continued

| Apoptotic Components | | |
|---|---|---|
| | LPTPSDIFVSYSTFPGFVSW RDPKSGSWYVETLDDIFEQW AHSEDLQSLLLRVANAVSVK GIYKQMPGCFNFLRKKLFFK TSVD | |
| Caspase 8 (SEQ ID NO: 421) | SESQTLDKVYQMKSKPRGYC LIINNFINFAKAREKVPKLH SIRDRNGTHLDAGALTTTFE ELHFEIKPHDDCTVEQIYEI LKIYQLMDHSNMDCFICCIL SHGDKGIIYGTDGQEAPIYE LTSQFTGLKCPSLAGKPKVF FIQACQGDNYQKGIPVETDS EEQPYLEMDLSSPQTRYIPD EADFLLGMATVNNCVSYRNP AEGTWYIQSLCQSLRERCPR GDDILTILTEVNYEVSNKDD KKNMGKQMPQPTFTLRKKLV FPSD | Pajvani, U.B., et al. (2005). Nat. Med. 11, 797-803 |
| Split caspase 3 (p12) (SEQ ID NO: 663) | SGVDDDMACHKIPVEADFLY AYSTAPGYYSWRNSKDGSWF IQSLCAMLKQYADKLEFMHI LTRVNRKVATEFESFSFDAT FHAKKQIPCIVSMLTKELYF YH | Chelur, D.S., and Chalfie, M. (2007). Proc. Natl. Acad. Sci. U.S.A. 104, 2283-2288 |
| Split caspase 3 (p17) (SEQ ID NO: 422) | SGISLDNSYKMDYPEMGLCII INNKNFHKSTGMTSRSGTDVD AANLRETFRNLKYEVRNKNDL TREEIVELMRDVSKEDHSKRS SFVCVLLSHGEEGIIFGTNGP VDLKKITNFFRGDRCRSLTGK PKLFIIQACRGTELDCGIETD | Chelur, D.S., and Chalfie, M. (2007). Proc. Natl. Acad. Sci. U.S.A. 104, 2283-2288 |
| SNIPPER N-TEV (SEQ ID NO: 423) | GESLFKGPRDYNPISSTICHL TNESDGHTTSLYGIGFGPFII TNKHLFRRNNGTLLVQSLHGV FKVKNTTTLQQHLIDGRDMII IRMPKDFPPFPQKLKFREPQR EERICLVTTNFQT | Gray, D C., et al. (2010) Cell 142, 637-646 |
| SNIPPER C-TEV (SEQ ID NO: 424) | KSMSSMVSDTSCTFPSSDGIF WKHWIQTKDGQCGSPLVSTRD GFIVGIHSASNFTNTNNYFTS VPKNFMELLTNQEAQQWVSGW RLNADSVLWGGHKVFMV | Gray, D C., et al. (2010) Cell 142, 637-646 |
| SNIPPER Caspase 7 (SEQ ID NO: 425) | ATGGCAGATGATCAGGGCTGTA TTGAAGAGCAGGGGGTTGAGGA TTCAGCAAATGAAGATTCAGTG GAAAATCTCTACTTCCAGGCTA AGCCAGACCGGTCCTCGTTTGT ACCGTCCCTCTTCAGTAAGAAG AAGAAAAATGTCACCATGCGAT CCATCAAGACCACCCGGGACCG AGTGCCTACATATCAGTACAAC ATGAATTTTGAAAAGCTGGGCA AATGCATCATAATAAACAACAA GAACTTTGATAAAGTGACAGGT ATGGGCGTTCGAAACGGAACAG ACAAAGATGCCGAGGCGCTCTT CAAGTGCTTCCGAAGCCTGGGT TTTGACGTGATTGTCTATAATG ACTGCTCTTGTGCCAAGATGCA AGATCTGCTTAAAAAAGCTTCT GAAGAGGACCATACAAATGCCG CCTGCTTCGCCTGCATCCTCTT AAGCCATGGAGAAGAAAATGTA ATTTATGGGAAAGATGGTGTCA CACCAATAAAGGATTTGACAGC CCACTTTAGGGGGGATAGATGC AAAACCCTTTTAGAGAAACCCA AACTCTTCTTCATTCAGGCTTG CCGAGGGACCGAGCTTGATGAT GGCATCCAGGCCGAAAATCTCT ACTTCCAGTCGGGGCCCATCAA | Gray, D C., et al. (2010) Cell 142, 637-646 |

TABLE 3-continued

| Apoptotic Components | | |
|---|---|---|
| | TGACACAGATGCTAATCCTCGA<br>TACAAGATCCCAGTGGAAGCTG<br>ACTTCCTCTTCGCCTATTCCAC<br>GGTTCCAGGCTATTACTCGTGG<br>AGGAGCCCAGGAAGAGGCTCCT<br>GGTTTGTGCAAGCCCTCTGCTC<br>CATCCTGGAGGAGCACGGAAAA<br>GACCTGGAAATCATGCAGATCC<br>TCACCAGGGTGAATGACAGAGT<br>TGCCAGGCACTTTGAGTCTCAG<br>TCTGATGACCCACACTTCCATG<br>AGAAGAAGCAGATCCCCTGTGT<br>GGTCTCCATGCTCACCAAGGAA<br>CTCTACTTCAGTCAA | |
| SNIPPER Caspase 3 (SEQ ID NO: 426) | ATGGAGAACACTGAAAACTCAG<br>TGGATTCAAAATCCATTAAAAA<br>TTTGGAACCAAAGATCATACAT<br>GGAAGCGAATCAATGGAAAATC<br>TCTACTTCCAGTCTGGAATATC<br>CCTGGACAACAGTTATAAAATG<br>GATTATCCTGAGATGGGTTTAT<br>GTATAATAATTAATAATAAGAA<br>TTTTCATAAAAGCACTGGAATG<br>ACATCTCGGTCTGGTACAGATG<br>TCGATGCAGCAAACCTCAGGGA<br>AACATTCAGAAACTTGAAATAT<br>GAAGTCAGGAATAAAAATGATC<br>TTACACGTGAAGAAATTGTGGA<br>ATTGATGCGTGATGTTTCTAAA<br>GAAGATCACAGCAAAAGGAGCA<br>GTTTTGTTTGTGTGCTTCTGAG<br>CCATGGTGAAGAAGGAATAATT<br>TTTGGAACAAATGGACCTGTTG<br>ACCTGAAAAAAATAACAAACTT<br>TTTCAGAGGGGATCGTTGTAGA<br>AGTCTAACTGGAAAACCCAAAC<br>TTTTCATTATTCAGGCCTGCCG<br>TGGTACAGAACTGGACTGTGGC<br>ATTGAGACAGAAAATCTCTACT<br>TCCAGAGTGGTGTTGATGATGA<br>CATGGCGTGTCATAAAATACCA<br>GTGGAGGCCGACTTCTTGTATG<br>CATACTCCACAGCACCTGGTTA<br>TTATTCTTGGCGAAATTCAAAG<br>GATGGCTCCTGGTTCATCCAGT<br>CGCTTTGTGCCATGCTGAAACA<br>GTATGCCGACAAGCTTGAATTT<br>ATGCACATTCTTACCCGGGTTA<br>ACCGAAAGGTGGCAACAGAATT<br>TGAGTCCTTTTCCTTTGACGCT<br>ACTTTTCATGCAAAGAAACAGA<br>TTCCATGTATTGTTTCCATGCT<br>CACAAAAGAACTCTATTTTTAT<br>CAC | Gray, D C., et al. (2010) Cell 142, 637-646 |

Split-Detection Constructs

A system of the invention further includes guides for localizing the CRISPR proteins with linked enzyme portions on a transcript of interest that may be present in a cell or tissue. According, the system includes a first guide that binds to the first CRISPR protein and hybridizes to the transcript of interest and a second guide that binds to the second CRISPR protein and hybridizes to the nucleic acid of interest. In most embodiments, it is preferred that the first and second guide hybridize to the nucleic acid of interest at adjacent locations. The locations can be directly adjacent or separated by a few nucleotides, such as separated by 1 nt, 2 nts, 3 nts, 4 nts, 5 nts, 6 nts, 7 nts, 8 nts, 9 nts, 10 nts, 11 nts, 12 nts, or more. In certain embodiments, the first and second guides can bind to locations separated on a nucleic acid by an expected stem loop. Though separated along the linear nucleic acid, the nucleic acid may take on a secondary structure that brings the guide target sequences into close proximity.

In an embodiment of the invention, the proteolytic enzyme comprises a caspase. In an embodiment of the invention, the proteolytic enzyme comprises an initiator caspase, such as, but not limited to, caspase 8 or caspase 9. Initiator caspases are generally inactive as a monomer and gain activity upon homodimerization. In an embodiment of the invention, the proteolytic enzyme comprises an effector caspase, such as, but not limited to, caspase 3 or caspase 7. Such initiator caspases are normally inactive until cleaved into fragments. Once cleaved, the fragments associate to form an active enzyme. In one exemplary embodiment, the first portion of the proteolytic enzyme comprises caspase 3 p12 and the complementary portion of the proteolytic enzyme comprises caspase 3 p17.

In an embodiment of the invention, the proteolytic enzyme is chosen to target a particular amino acid sequence and a substrate is chosen or engineered accordingly. A non-limiting example of such a protease is tobacco etch virus (TEV) protease. Accordingly, a substrate cleavable by TEV protease, which in some embodiments is engineered to be cleavable, serves as the system component acted upon by the protease. In one embodiment, the TEV protease substrate comprises a procaspase and one or more TEV cleavage sites. The procaspase can be, for example, caspase 3 or caspase 7 engineered to be cleavable by the reconstituted TEV protease. Once cleaved, the procaspase fragments are free to take on an active confirmation.

In an embodiment of the invention, the TEV substrate comprises a fluorescent protein and a TEV cleavage site. In another embodiment, the TEV substrate comprises a luminescent protein and a TEV cleavage site. In certain embodiments, the TEV cleavage site provides for cleavage of the substrate such that the fluorescent or luminescent property of the substrate protein is lost upon cleavage. In certain embodiments, the fluorescent or luminescent protein can be modified, for example by appending a moiety which interferes with fluorescence or luminescence which is then cleaved when the TEV protease is reconstituted.

According to the invention, there is provided a method of providing a proteolytic activity in a cell which contains a nucleic acid of interest, which comprises contacting the nucleic acid in the cell with a composition which comprises a first CRIPSR protein linked to an inactive first portion of a proteolytic enzyme, and a second CRISPR protein linked to the complementary portion of the proteolytic enzyme wherein the activity of the proteolytic enzyme is reconstituted when the first portion and the complementary portion of the protein are contacted, and a first guide that binds to the first CRISPR protein and hybridizes to a first target sequence of the nucleic acid, and a second guide that binds to the second CRISPR protein and hybridizes to a second target sequence of the nucleic acid. When the target nucleic acid of interest is present, the first and second portions of the proteolytic enzyme are contacted, the proteolytic activity of the enzyme is reconstituted, and a substrate of the enzyme is cleaved.

Split-fluorophore constructs are useful for imaging with reduced background via reconstitution of a split fluorophore upon binding of two C2c1 proteins to a transcript. These split proteins include iSplit (Filonov, G. S., and Verkhusha, V. V. (2013). *A near-infrared BiFC reporter for in vivo imaging of protein-protein interactions. Chem. Biol.* 20, 1078-1086.), Split Venus (Wu, B., Chen, J., and Singer, R. H. (2014). *Background free imaging of single mRNAs in live cells using split fluorescent proteins. Sci. Rep.* 4, 3615.), and Split superpositive GFP (Blakeley, B. D., Chapman, A. M., and McNaughton, B. R. (2012). *Split-superpositive GFP reassembly is a fast, efficient, and robust method for detecting protein-protein interactions in vivo. Mol. Biosyst.* 8, 2036-2040.). Such proteins are set forth in Table 4 below:

TABLE 4

| Imaging Components | | |
|---|---|---|
| iSplit PAS domain of iRFP (N-term) (SEQ ID NO: 427) | MAEGSVARQPDLLTCDDEPIHIPGAIQPH GLLLALAADMTIVAGSDNLPELTGLAIGA LIGRSAADVFDSETHNRLTIALAEPGAAV GAPITVGFTMRKDAGFIGSWHRHDQLIFL ELEPPQRGGSEVSALEKEVSALEKEVSAL EKEVSALEKEVSALEKGGS* | Filonov, G. S., and Verkhusha, V. V. (2013). Chem. Biol. 20, 1078-1086 |
| iSplit GAFm domain of iRFP (C-term) (SEQ ID NO: 428) | MGGSKVSALKEKVSALKEKVSALKEKVS ALKEKVSALKEGGSPPQRDVAEPQAFFRR TNSAIRRLQAAETLESACAAAAQEVRKIT GYDRVMIYRFASDFSGEVIAEDRCAEVES KLGLHYPASTVPAQARRLYTINPVRIIPD INYRPVPVTPYLNPVTGRPIDLSFAILRS VSPVHLEFMRNIGMHGTMSISILRGERLW GLIVCHHRTPYYVDLDGRQACELVAQVLA RQIGVMEE* | Filonov, G. S., and Verkhusha, V. V. (2013). Chem. Biol. 20, 1078-1086 |
| Split Venus N-term (SEQ ID NO: 429) | MVSKGEELFTGVVPILVELDGDVNGHKFS VSGEGEGDATYGKLTLKLICTTGKLPVPW PTLVTTLGYGLQCFARYPDHMKQHDFFKS AMPEGYVQERTIFFKDDGNYKTRAEVKFE GDTLVNRIELKGIDFKEDGNILGHKLEYN YNSHNVYIT* | Wu, B., Chen, J., and Singer, R. H. (2014). Sci. Rep. 4, 3615. |
| Split Venus C-term (SEQ ID NO: 430) | ADKQKNGIKANFKIRHNIEDGGVQLADHY QQNTPIGDGPVLLPDNHYLSYQSALSKDP NEKRDHMVLLEFVTAAGITLGMDELYK | Wu, B., Chen, J., and Singer, R. H. (2014). Sci. Rep. 4, 3615. |
| Split super-positive GFP N-term (SEQ ID NO: 431) | SKGERLFRGKVPILVELKGDVNGHKFSVR GEGKGDATRGKLTLKFICTTGKLPVPWPT LVTTLTYGVQCFSRYPKHMKRHDFFKSA MPKGYVQERTISFKKDGKYKTRAEVKFE GRTLVNRIKLKGRDFKEKGNILGHKLRYN FNSHKVYITADKR | Blakeley, B. D., Chapman, A. M., and McNaughton, B. R. (2012). Mol. Biosyst. 8, 2036-2040. |
| Split super-positive GFP C-term (SEQ ID NO: 432) | KNGIKAKFKIRHNVKDGSVQLADHYQQN TPIGRGPVLLPRNHYLSTRSKLSKDPKEK RDHMVLLEFVTAAGIKHGRDERYK | Blakeley, B. D., Chapman, A. M., and McNaughton, B. R. (2012). Mol. Biosyst. 8, 2036-2040. |

Target Enrichment with dCas

In certain example embodiments, target RNA or DNA may first be enriched prior to detection or amplification of the target RNA or DNA. In certain example embodiments, this enrichment may be achieved by binding of the target nucleic acids by a CRISPR effector system.

Current target-specific enrichment protocols require single-stranded nucleic acid prior to hybridization with probes. Among various advantages, the present embodiments can skip this step and enable direct targeting to double-stranded DNA (either partly or completely double-stranded). In addition, the embodiments disclosed herein are enzyme-driven targeting methods that offer faster kinetics and easier workflow allowing for isothermal enrichment. In certain example embodiments, enrichment may take place at temperatures as low as 20-37° C. In certain example embodiments, a set of guide RNAs to different target nucleic acids are used in a single assay, allowing for detection of multiple targets and/or multiple variants of a single target.

In certain example embodiments, a dead CRISPR effector protein may bind the target nucleic acid in solution and then subsequently be isolated from said solution. For example, the dead CRISPR effector protein bound to the target nucleic acid may be isolated from the solution using an antibody or other molecule, such as an aptamer, that specifically binds the dead CRISPR effector protein.

In other example embodiments, the dead CRISPR effector protein may bind to a solid substrate. A fixed substrate may refer to any material that is appropriate for or can be modified to be appropriate for the attachment of a polypeptide or a polynucleotide. Possible substrates include, but are not limited to, glass and modified functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, ceramics, resins, silica or silica-based materials including silicon and modified silicon, carbon, metals, inorganic glasses, plastics, optical fiber bundles, and a variety of other polymers. In some embodiments, the solid support comprises a patterned surface suitable for immobilization of molecules in an ordered pattern. In certain embodiments, a patterned surface refers to an arrangement of different regions in or on an exposed layer of a solid support. In some embodiments, the solid support comprises an array of wells or depressions in a surface. The composition and geometry of the solid support can vary with its use. In some embodiments, the solid support is a planar structure such as a slide, chip, microchip and/or array. As such, the surface of the substrate can be in the form of a planar layer. In some embodiments, the solid support comprises one or more surfaces of a flowcell. The term "flowcell" as used herein refers to a chamber comprising a solid surface across which one or more fluid reagents can be flowed. Example flowcells and related fluidic systems and detection platforms that can be readily used in the methods of the present disclosure are described, for example, in Bentley et al. Nature 456:53-59 (2008), WO 04/0918497, U.S. Pat. No. 7,057,026; WO 91/06678; WO 07/123744; U.S. Pat. Nos. 7,329,492; 7,211,414; 7,315,019; 7,405,281, and US 2008/0108082. In some embodiments, the solid support or its surface is non-planar, such as the inner or outer surface of a tube or vessel. In some embodiments, the solid support comprises microspheres or beads. "Microspheres," "beads," and "particles" are intended to mean, within the context of a solid substrate, small discrete particles made of various materials including, but not limited to, plastics, ceramics, glass, and polystyrene. In certain embodiments, the microspheres are magnetic microspheres or beads. Alternatively or additionally, the beads may be porous. The bead sizes range from nanometers, e.g., 100 nm, to millimeters, e.g., 1 mm.

A sample containing, or suspected of containing, the target nucleic acids may then be exposed to the substrate to allow binding of the target nucleic acids to the bound dead CRISPR effector protein. Non-target molecules may then be washed away. In certain example embodiments, the target nucleic acids may then be released from the CRISPR effector protein/guide RNA complex for further detection using the methods disclosed herein. In certain example embodiments, the target nucleic acids may first be amplified as described herein.

In certain example embodiments, the CRISPR effector may be labeled with a binding tag. In certain example embodiments, the CRISPR effector may be chemically tagged. For example, the CRISPR effector may be chemically biotinylated. In another example embodiment, a fusion may be created by adding additional sequence encoding a fusion to the CRISPR effector. One example of such a fusion is an AviTag™, which employs a highly targeted enzymatic conjugation of a single biotin on a unique 15 amino acid peptide tag. In certain embodiments, the CRISPR effector may be labeled with a capture tag such as, but not limited to, GST, Myc, hemagglutinin (HA), green fluorescent protein (GFP), flag, His tag, TAP tag, and Fc tag. The binding tag, whether a fusion, chemical tag, or capture tag, may be used to either pull down the CRISPR effector system once it has bound a target nucleic acid or to fix the CRISPR effector system on the solid substrate.

In certain example embodiments, the guide RNA may be labeled with a binding tag. In certain example embodiments, the entire guide RNA may be labeled using in vitro transcription (IVT) incorporating one or more biotinylated nucleotides, such as, biotinylated uracil. In some embodiments, biotin can be chemically or enzymatically added to the guide RNA, such as, the addition of one or more biotin groups to the 3' end of the guide RNA. The binding tag may be used to pull down the guide RNA/target nucleic acid complex after binding has occurred, for example, by exposing the guide RNA/target nucleic acid to a streptavidin coated solid substrate.

Truncations

In certain example embodiments, the Cas12 protein may be truncated. In certain example embodiments, the truncated version may be a deactivated or dead Cas12 protein. The Cas12 protein may be modified on the N-terminus, C-terminus, or both. In one example embodiment, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 amino acids are removed from the N-terminus, C-terminus, or combination thereof. In another example embodiment, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, or 150 amino acids are removed from the C-terminus. In certain example embodiments, 1-10, 1-20, 1-30, 1-40, 1-50, 1-60, 1-70, 1-80, 1-90, 1-100, 1-110, 1-120, 1-130, 1-140, 1-150, 1-160, 1-170, 1-180, 1-190, 1-200, 1-220, 1-230, 1-240, 1-250, 200-250, 100-200, 110-200, 120-200, 130-200, 140-200, 150-200, 160-200, 170-200, 180-200, 190-200, 10-100, 20-100, 30-100, 40-100, 50-100, 60-100, 70-100, 80-100, 90-100, or 150-250 amino acids are removed the N-terminus, C-terminus or a combination thereof. In certain example embodiments, the amino acid positions are those of BhCas12b or amino acids of orthologs corresponding thereto. In certain example embodiments, the truncations may be fused or otherwise attached to nucleotide deaminase and used in the base editing embodiments disclosed in further detail below.

Base Editing

In certain example embodiments, a Cas12b, e.g., dCas12b, can be fused with an adenosine deaminase or cytidine deaminase for base editing purposes.

Adenosine Deaminase

The term "adenosine deaminase" or "adenosine deaminase protein" as used herein refers to a protein, a polypeptide, or one or more functional domain(s) of a protein or a polypeptide that is capable of catalyzing a hydrolytic deamination reaction that converts an adenine (or an adenine moiety of a molecule) to a hypoxanthine (or a hypoxanthine moiety of a molecule), as shown below. In some embodiments, the adenine-containing molecule is an adenosine (A), and the hypoxanthine-containing molecule is an inosine (I). The adenine-containing molecule can be deoxyribonucleic acid (DNA) or ribonucleic acid (RNA).

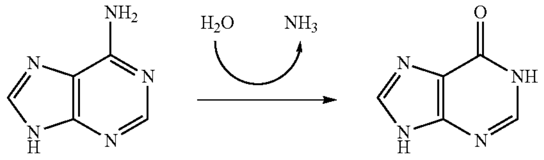

Adenine

Hypoxanthine

According to the present disclosure, adenosine deaminases that can be used in connection with the present disclosure include, but are not limited to, members of the enzyme family known as adenosine deaminases that act on RNA (ADARs), members of the enzyme family known as adenosine deaminases that act on tRNA (ADATs), and other adenosine deaminase domain-containing (ADAD) family members. According to the present disclosure, the adenosine deaminase is capable of targeting adenine in RNA/DNA and RNA duplexes. Indeed, Zheng et al. (Nucleic Acids Res. 2017, 45(6): 3369-3377) demonstrate that ADARs can carry out adenosine to inosine editing reactions on RNA/DNA and RNA/RNA duplexes. In particular embodiments, the adenosine deaminase has been modified to increase its ability to edit DNA in an RNA/DNA heteroduplex of an RNA duplex as detailed herein below.

In some embodiments, the adenosine deaminase is derived from one or more metazoa species, including but not limited to, mammals, birds, frogs, squids, fish, flies, and worms. In some embodiments, the adenosine deaminase is a human, squid, or *Drosophila* adenosine deaminase.

In some embodiments, the adenosine deaminase is a human ADAR, including hADAR1, hADAR2, hADAR3. In some embodiments, the adenosine deaminase is a *Caenorhabditis elegans* ADAR protein, including ADR-1 and ADR-2. In some embodiments, the adenosine deaminase is a *Drosophila* ADAR protein, including dAdar. In some embodiments, the adenosine deaminase is a squid *Loligo pealeii* ADAR protein, including sqADAR2a and sqADAR2b. In some embodiments, the adenosine deaminase is a human ADAT protein. In some embodiments, the adenosine deaminase is a *Drosophila* ADAT protein. In some embodiments, the adenosine deaminase is a human ADAD protein, including TENR (hADAD1) and TENRL (hADAD2).

In some embodiments, the adenosine deaminase is a TadA protein such as *E. coli* TadA. See Kim et al., Biochemistry 45:6407-6416 (2006); Wolf et al., EMBO J. 21:3841-3851 (2002). In some embodiments, the adenosine deaminase is mouse ADA. See Grunebaum et al., Curr. Opin. Allergy Clin. Immunol. 13:630-638 (2013). In some embodiments, the adenosine deaminase is human ADAT2. See Fukui et al., J. Nucleic Acids 2010:260512 (2010). In some embodiments, the deaminase (e.g., adenosine or cytidine deaminase) is one or more of those described in Cox et al., Science. 2017, November 24; 358(6366): 1019-1027; Komore et al., Nature. 2016 May 19; 533(7603):420-4; and Gaudelli et al., Nature. 2017 Nov. 23; 551(7681):464-471.

In some embodiments, the adenosine deaminase protein recognizes and converts one or more target adenosine residue(s) in a double-stranded nucleic acid substrate into inosine residues(s). In some embodiments, the double-stranded nucleic acid substrate is an RNA-DNA hybrid duplex. In some embodiments, the adenosine deaminase protein recognizes a binding window on the double-stranded substrate. In some embodiments, the binding window contains at least one target adenosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the adenosine deaminase protein comprises one or more deaminase domains. Not intended to be bound by a particular theory, it is contemplated that the deaminase domain functions to recognize and convert one or more target adenosine (A) residue(s) contained in a double-stranded nucleic acid substrate into inosine (I) residue(s). In some embodiments, the deaminase domain comprises an active center. In some embodiments, the active center comprises a zinc ion. In some embodiments, during the A-to-I editing process, base pairing at the target adenosine residue is disrupted, and the target adenosine residue is "flipped" out of the double helix to become accessible by the adenosine deaminase. In some embodiments, amino acid residues in or near the active center interact with one or more nucleotide(s) 5' to a target adenosine residue. In some embodiments, amino acid residues in or near the active center interact with one or more nucleotide(s) 3' to a target adenosine residue. In some embodiments, amino acid residues in or near the active center further interact with the nucleotide complementary to the target adenosine residue on the opposite strand. In some embodiments, the amino acid residues form hydrogen bonds with the 2' hydroxyl group of the nucleotides.

In some embodiments, the adenosine deaminase comprises human ADAR2 full protein (hADAR2) or the deaminase domain thereof (hADAR2-D). In some embodiments, the adenosine deaminase is an ADAR family member that is homologous to hADAR2 or hADAR2-D.

Particularly, in some embodiments, the homologous ADAR protein is human ADAR1 (hADAR1) or the deaminase domain thereof (hADAR1-D). In some embodiments, glycine 1007 of hADAR1-D corresponds to glycine 487 hADAR2-D, and glutamic Acid 1008 of hADAR1-D corresponds to glutamic acid 488 of hADAR2-D.

In some embodiments, the adenosine deaminase comprises the wild-type amino acid sequence of hADAR2-D. In some embodiments, the adenosine deaminase comprises one or more mutations in the hADAR2-D sequence, such that the editing efficiency, and/or substrate editing preference of hADAR2-D is changed according to specific needs.

Certain mutations of hADAR1 and hADAR2 proteins have been described in Kuttan et al., Proc Natl Acad Sci USA. (2012) 109(48):E3295-304; Want et al. ACS Chem Biol. (2015) 10(11):2512-9; and Zheng et al. Nucleic Acids Res. (2017) 45(6):3369-337, each of which is incorporated herein by reference in its entirety.

In some embodiments, the adenosine deaminase comprises a mutation at glycine336 of the hADAR2-D amino acid sequence, or a corresponding position in a homologous ADAR protein. In some embodiments, the glycine residue at position 336 is replaced by an aspartic acid residue (G336D).

In some embodiments, the adenosine deaminase comprises a mutation at Glycine487 of the hADAR2-D amino acid sequence, or a corresponding position in a homologous ADAR protein. In some embodiments, the glycine residue at position 487 is replaced by a non-polar amino acid residue with relatively small side chains. For example, in some embodiments, the glycine residue at position 487 is replaced by an alanine residue (G487A). In some embodiments, the glycine residue at position 487 is replaced by a valine residue (G487V). In some embodiments, the glycine residue at position 487 is replaced by an amino acid residue with relatively large side chains. In some embodiments, the glycine residue at position 487 is replaced by an arginine residue (G487R). In some embodiments, the glycine residue at position 487 is replaced by a lysine residue (G487K). In some embodiments, the glycine residue at position 487 is replaced by a tryptophan residue (G487 W). In some embodiments, the glycine residue at position 487 is replaced by a tyrosine residue (G487Y).

In some embodiments, the adenosine deaminase comprises a mutation at glutamic acid488 of the hADAR2-D amino acid sequence, or a corresponding position in a homologous ADAR protein. In some embodiments, the glutamic acid residue at position 488 is replaced by a glutamine residue (E488Q). In some embodiments, the glutamic acid residue at position 488 is replaced by a histidine residue (E488H). In some embodiments, the glutamic acid residue at position 488 is replace by an arginine residue (E488R). In some embodiments, the glutamic acid residue at position 488 is replace by a lysine residue (E488K). In some embodiments, the glutamic acid residue at position 488 is replace by an asparagine residue (E488N). In some embodiments, the glutamic acid residue at position 488 is replace by an alanine residue (E488A). In some embodiments, the glutamic acid residue at position 488 is replace by a Methionine residue (E488M). In some embodiments, the glutamic acid residue at position 488 is replace by a serine residue (E488S). In some embodiments, the glutamic acid residue at position 488 is replace by a phenylalanine residue (E488F). In some embodiments, the glutamic acid residue at position 488 is replace by a lysine residue (E488L). In some embodiments, the glutamic acid residue at position 488 is replace by a tryptophan residue (E488 W).

In some embodiments, the adenosine deaminase comprises a mutation at threonine490 of the hADAR2-D amino acid sequence, or a corresponding position in a homologous ADAR protein. In some embodiments, the threonine residue at position 490 is replaced by a cysteine residue (T490C). In some embodiments, the threonine residue at position 490 is replaced by a serine residue (T490S). In some embodiments, the threonine residue at position 490 is replaced by an alanine residue (T490A). In some embodiments, the threonine residue at position 490 is replaced by a phenylalanine residue (T490F). In some embodiments, the threonine residue at position 490 is replaced by a tyrosine residue (T490Y). In some embodiments, the threonine residue at position 490 is replaced by a serine residue (T490R). In some embodiments, the threonine residue at position 490 is replaced by an alanine residue (T490K). In some embodiments, the threonine residue at position 490 is replaced by a phenylalanine residue (T490P). In some embodiments, the threonine residue at position 490 is replaced by a tyrosine residue (T490E).

In some embodiments, the adenosine deaminase comprises a mutation at valine493 of the hADAR2-D amino acid sequence, or a corresponding position in a homologous ADAR protein. In some embodiments, the valine residue at position 493 is replaced by an alanine residue (V493A). In some embodiments, the valine residue at position 493 is replaced by a serine residue (V493S). In some embodiments, the valine residue at position 493 is replaced by a threonine residue (V493T). In some embodiments, the valine residue at position 493 is replaced by an arginine residue (V493R). In some embodiments, the valine residue at position 493 is replaced by an aspartic acid residue (V493D). In some embodiments, the valine residue at position 493 is replaced by a proline residue (V493P). In some embodiments, the valine residue at position 493 is replaced by a glycine residue (V493G).

In some embodiments, the adenosine deaminase comprises a mutation at alanine589 of the hADAR2-D amino acid sequence, or a corresponding position in a homologous ADAR protein. In some embodiments, the alanine residue at position 589 is replaced by a valine residue (A589V).

In some embodiments, the adenosine deaminase comprises a mutation at asparagine597 of the hADAR2-D amino acid sequence, or a corresponding position in a homologous ADAR protein. In some embodiments, the asparagine residue at position 597 is replaced by a lysine residue (N597K). In some embodiments, the adenosine deaminase comprises a mutation at position 597 of the amino acid sequence, which has an asparagine residue in the wild type sequence. In some embodiments, the asparagine residue at position 597 is replaced by an arginine residue (N597R). In some embodiments, the adenosine deaminase comprises a mutation at position 597 of the amino acid sequence, which has an asparagine residue in the wild type sequence. In some embodiments, the asparagine residue at position 597 is replaced by an alanine residue (N597A). In some embodiments, the adenosine deaminase comprises a mutation at position 597 of the amino acid sequence, which has an asparagine residue in the wild type sequence. In some embodiments, the asparagine residue at position 597 is replaced by a glutamic acid residue (N597E). In some embodiments, the adenosine deaminase comprises a mutation at position 597 of the amino acid sequence, which has an asparagine residue in the wild type sequence. In some embodiments, the asparagine residue at position 597 is replaced by a histidine residue (N597H). In some embodiments, the adenosine deaminase comprises a mutation at position 597 of the amino acid sequence, which has an asparagine residue in the wild type sequence. In some embodiments, the asparagine residue at position 597 is replaced by a glycine residue (N597G). In some embodiments, the adenosine deaminase comprises a mutation at position 597 of the amino acid sequence, which has an asparagine residue in the wild type sequence. In some embodiments, the asparagine residue at position 597 is replaced by a tyrosine residue (N597Y). In some embodiments, the asparagine residue at position 597 is replaced by a phenylalanine residue (N597F). In some embodiments, the adenosine deaminase comprises mutation N597I. In some embodiments, the adenosine deaminase comprises mutation N597L. In some embodiments, the adenosine deaminase comprises mutation N597V. In some embodiments, the adenosine deaminase comprises mutation N597M. In some embodiments, the adenosine deaminase comprises mutation N597C. In some embodiments, the adenosine deaminase comprises mutation N597P. In some embodiments, the adenosine deaminase comprises mutation N597T. In some embodiments, the adenosine deaminase comprises mutation N597S. In some embodiments, the adenosine deaminase comprises mutation N597 W. In some embodiments, the adenosine deaminase comprises mutation N597Q. In some embodiments, the adenosine deaminase comprises mutation N597D. In certain example embodiments, the mutations at N597 described above are further made in the context of an E488Q background.

In some embodiments, the adenosine deaminase comprises a mutation at serine599 of the hADAR2-D amino acid sequence, or a corresponding position in a homologous ADAR protein. In some embodiments, the serine residue at position 599 is replaced by a threonine residue (S599T).

In some embodiments, the adenosine deaminase comprises a mutation at asparagine613 of the hADAR2-D amino acid sequence, or a corresponding position in a homologous ADAR protein. In some embodiments, the asparagine residue at position 613 is replaced by a lysine residue (N613K). In some embodiments, the adenosine deaminase comprises a mutation at position 613 of the amino acid sequence, which has an asparagine residue in the wild type sequence. In some embodiments, the asparagine residue at position 613 is replaced by an arginine residue (N613R). In some embodiments, the adenosine deaminase comprises a mutation at position 613 of the amino acid sequence, which has an asparagine residue in the wild type sequence. In some embodiments, the asparagine residue at position 613 is replaced by an alanine residue (N613A) In some embodiments, the adenosine deaminase comprises a mutation at position 613 of the amino acid sequence, which has an asparagine residue in the wild type sequence. In some embodiments, the asparagine residue at position 613 is replaced by a glutamic acid residue (N613E). In some embodiments, the adenosine deaminase comprises mutation N613I. In some embodiments, the adenosine deaminase comprises mutation N613L. In some embodiments, the adenosine deaminase comprises mutation N613V. In some embodiments, the adenosine deaminase comprises mutation N613F. In some embodiments, the adenosine deaminase comprises mutation N613M. In some embodiments, the adenosine deaminase comprises mutation N613C. In some embodiments, the adenosine deaminase comprises mutation N613G. In some embodiments, the adenosine deaminase comprises mutation N613P. In some embodiments, the adenosine deaminase comprises mutation N613T. In some embodiments, the adenosine deaminase comprises mutation N613S. In some embodiments, the adenosine deaminase comprises mutation N613Y. In some embodiments, the adenosine deaminase comprises mutation N613 W. In some embodiments, the adenosine deaminase comprises mutation N613Q. In some embodiments, the adenosine deaminase comprises mutation N613H. In some embodiments, the adenosine deaminase comprises mutation N613D. In some embodiments, the mutations at N613 described above are further made in combination with a E488Q mutation.

In some embodiments, to improve editing efficiency, the adenosine deaminase may comprise one or more of the mutations: G336D, G487A, G487V, E488Q, E488H, E488R, E488N, E488A, E488S, E488M, T490C, T490S, V493T, V493S, V493A, V493R, V493D, V493P, V493G, N597K, N597R, N597A, N597E, N597H, N597G, N597Y, A589V, S599T, N613K, N613R, N613A, N613E, based on amino acid sequence positions of hADAR2-D, and mutations in a homologous ADAR protein corresponding to the above.

In some embodiments, to reduce editing efficiency, the adenosine deaminase may comprise one or more of the mutations: E488F, E488L, E488 W, T490A, T490F, T490Y, T490R, T490K, T490P, T490E, N597F, based on amino acid sequence positions of hADAR2-D, and mutations in a homologous ADAR protein corresponding to the above. In particular embodiments, it can be of interest to use an adenosine deaminase enzyme with reduced efficacy to reduce off-target effects.

In some embodiments, to reduce off-target effects, the adenosine deaminase comprises one or more of mutations at R348, V351, T375, K376, E396, C451, R455, N473, R474, K475, R477, R481, S486, E488, T490, S495, R510, based on amino acid sequence positions of hADAR2-D, and mutations in a homologous ADAR protein corresponding to the above. In some embodiments, the adenosine deaminase comprises mutation at E488 and one or more additional positions selected from R348, V351, T375, K376, E396, C451, R455, N473, R474, K475, R477, R481, S486, T490, S495, R510. In some embodiments, the adenosine deaminase comprises mutation at T375, and optionally at one or more additional positions. In some embodiments, the adenosine deaminase comprises mutation at N473, and optionally at one or more additional positions. In some embodiments, the adenosine deaminase comprises mutation at V351, and optionally at one or more additional positions. In some embodiments, the adenosine deaminase comprises mutation at E488 and T375, and optionally at one or more additional positions. In some embodiments, the adenosine deaminase comprises mutation at E488 and N473, and optionally at one or more additional positions. In some embodiments, the adenosine deaminase comprises mutation E488 and V351, and optionally at one or more additional positions. In some embodiments, the adenosine deaminase comprises mutation at E488 and one or more of T375, N473, and V351.

In some embodiments, to reduce off-target effects, the adenosine deaminase comprises one or more of mutations selected from R348E, V351L, T375G, T375S, R455G, R455S, R455E, N473D, R474E, K475Q, R477E, R481E, S486T, E488Q, T490A, T490S, S495T, and R510E, based on amino acid sequence positions of hADAR2-D, and mutations in a homologous ADAR protein corresponding to the above. In some embodiments, the adenosine deaminase comprises mutation E488Q and one or more additional mutations selected from R348E, V351L, T375G, T375S, R455G, R455S, R455E, N473D, R474E, K475Q, R477E, R481E, S486T, T490A, T490S, S495T, and R510E. In some embodiments, the adenosine deaminase comprises mutation T375G or T375S, and optionally one or more additional mutations. In some embodiments, the adenosine deaminase comprises mutation N473D, and optionally one or more additional mutations. In some embodiments, the adenosine deaminase comprises mutation V351L, and optionally one or more additional mutations. In some embodiments, the adenosine deaminase comprises mutation E488Q, and T375G or T375G, and optionally one or more additional mutations. In some embodiments, the adenosine deaminase comprises mutation E488Q and N473D, and optionally one or more additional mutations. In some embodiments, the adenosine deaminase comprises mutation E488Q and V351L, and optionally one or more additional mutations. In some embodiments, the adenosine deaminase comprises mutation E488Q and one or more of T375G/S, N473D and V351L.

In certain examples, the adenosine deaminase protein or catalytic domain thereof has been modified to comprise a mutation at E488, preferably E488Q, of the hADAR2-D amino acid sequence, or a corresponding position in a homologous ADAR protein and/or wherein the adenosine deaminase protein or catalytic domain thereof has been modified to comprise a mutation at T375, preferably T375G of the hADAR2-D amino acid sequence, or a corresponding position in a homologous ADAR protein. In certain examples, the adenosine deaminase protein or catalytic domain thereof has been modified to comprise a mutation at E1008, preferably E1008Q, of the hADAR1d amino acid sequence, or a corresponding position in a homologous ADAR protein.

Crystal structures of the human ADAR2 deaminase domain bound to duplex RNA reveal a protein loop that binds the RNA on the 5' side of the modification site. This 5' binding loop is one contributor to substrate specificity differences between ADAR family members. See Wang et al., Nucleic Acids Res., 44(20):9872-9880 (2016), the content of which is incorporated herein by reference in its entirety. In addition, an ADAR2-specific RNA-binding loop was identified near the enzyme active site. See Mathews et al., Nat. Struct. Mol. Biol., 23(5):426-33 (2016), the content of which is incorporated herein by reference in its entirety. In some embodiments, the adenosine deaminase comprises one or more mutations in the RNA binding loop to improve editing specificity and/or efficiency.

In some embodiments, the adenosine deaminase comprises a mutation at alanine454 of the hADAR2-D amino acid sequence, or a corresponding position in a homologous ADAR protein. In some embodiments, the alanine residue at position 454 is replaced by a serine residue (A454S). In some embodiments, the alanine residue at position 454 is replaced by a cysteine residue (A454C). In some embodiments, the alanine residue at position 454 is replaced by an aspartic acid residue (A454D).

In some embodiments, the adenosine deaminase comprises a mutation at arginine455 of the hADAR2-D amino acid sequence, or a corresponding position in a homologous ADAR protein. In some embodiments, the arginine residue at position 455 is replaced by an alanine residue (R455A). In some embodiments, the arginine residue at position 455 is replaced by a valine residue (R455V). In some embodiments, the arginine residue at position 455 is replaced by a histidine residue (R455H). In some embodiments, the arginine residue at position 455 is replaced by a glycine residue (R455G). In some embodiments, the arginine residue at position 455 is replaced by a serine residue (R455S). In some embodiments, the arginine residue at position 455 is replaced by a glutamic acid residue (R455E). In some embodiments, the adenosine deaminase comprises mutation R455C. In some embodiments, the adenosine deaminase comprises mutation R455I. In some embodiments, the adenosine deaminase comprises mutation R455K. In some embodiments, the adenosine deaminase comprises mutation R455L. In some embodiments, the adenosine deaminase comprises mutation R455M. In some embodiments, the adenosine deaminase comprises mutation R455N. In some embodiments, the adenosine deaminase comprises mutation R455Q. In some embodiments, the adenosine deaminase comprises mutation R455F. In some embodiments, the adenosine deaminase comprises mutation R455 W. In some embodiments, the adenosine deaminase comprises mutation R455P. In some embodiments, the adenosine deaminase comprises mutation R455Y. In some embodiments, the adenosine deaminase comprises mutation R455E. In some embodiments, the adenosine deaminase comprises mutation R455D. In some embodiments, the mutations at R455 described above are further made in combination with an E488Q mutation.

In some embodiments, the adenosine deaminase comprises a mutation at isoleucine456 of the hADAR2-D amino acid sequence, or a corresponding position in a homologous ADAR protein. In some embodiments, the isoleucine residue at position 456 is replaced by a valine residue (I456V). In some embodiments, the isoleucine residue at position 456 is replaced by a leucine residue (I456L). In some embodiments, the isoleucine residue at position 456 is replaced by an aspartic acid residue (I456D).

In some embodiments, the adenosine deaminase comprises a mutation at phenylalanine457 of the hADAR2-D amino acid sequence, or a corresponding position in a homologous ADAR protein. In some embodiments, the phenylalanine residue at position 457 is replaced by a tyrosine residue (F457Y). In some embodiments, the phenylalanine residue at position 457 is replaced by an arginine residue (F457R). In some embodiments, the phenylalanine residue at position 457 is replaced by a glutamic acid residue (F457E).

In some embodiments, the adenosine deaminase comprises a mutation at serine458 of the hADAR2-D amino acid sequence, or a corresponding position in a homologous ADAR protein. In some embodiments, the serine residue at position 458 is replaced by a valine residue (S458V). In some embodiments, the serine residue at position 458 is replaced by a phenylalanine residue (S458F). In some embodiments, the serine residue at position 458 is replaced by a proline residue (S458P). In some embodiments, the adenosine deaminase comprises mutation S4581. In some embodiments, the adenosine deaminase comprises mutation S458L. In some embodiments, the adenosine deaminase comprises mutation S458M. In some embodiments, the adenosine deaminase comprises mutation S458C. In some embodiments, the adenosine deaminase comprises mutation S458A. In some embodiments, the adenosine deaminase comprises mutation S458G. In some embodiments, the adenosine deaminase comprises mutation S458T. In some embodiments, the adenosine deaminase comprises mutation S458Y. In some embodiments, the adenosine deaminase comprises mutation S458 W. In some embodiments, the adenosine deaminase comprises mutation S458Q. In some embodiments, the adenosine deaminase comprises mutation S458N. In some embodiments, the adenosine deaminase comprises mutation S458H. In some embodiments, the adenosine deaminase comprises mutation S458E. In some embodiments, the adenosine deaminase comprises mutation S458D. In some embodiments, the adenosine deaminase comprises mutation S458K. In some embodiments, the adenosine deaminase comprises mutation S458R. In some embodiments, the mutations at S458 described above are further made in combination with a E488Q mutation.

In some embodiments, the adenosine deaminase comprises a mutation at proline459 of the hADAR2-D amino acid sequence, or a corresponding position in a homologous ADAR protein. In some embodiments, the proline residue at position 459 is replaced by a cysteine residue (P459C). In some embodiments, the proline residue at position 459 is replaced by a histidine residue (P459H). In some embodiments, the proline residue at position 459 is replaced by a tryptophan residue (P459 W).

In some embodiments, the adenosine deaminase comprises a mutation at histidine460 of the hADAR2-D amino acid sequence, or a corresponding position in a homologous ADAR protein. In some embodiments, the histidine residue at position 460 is replaced by an arginine residue (H460R). In some embodiments, the histidine residue at position 460 is replaced by an isoleucine residue (H460I). In some embodiments, the histidine residue at position 460 is replaced by a proline residue (H460P). In some embodiments, the adenosine deaminase comprises mutation H460L. In some embodiments, the adenosine deaminase comprises mutation H460V. In some embodiments, the adenosine deaminase comprises mutation H460F. In some embodiments, the adenosine deaminase comprises mutation H460M. In some embodiments, the adenosine deaminase comprises mutation H460C. In some embodiments, the adenosine deaminase comprises mutation H460A. In some embodiments, the adenosine deaminase comprises mutation H460G. In some embodiments, the adenosine deaminase comprises mutation H460T. In some embodiments, the adenosine deaminase comprises mutation H460S. In some embodiments, the adenosine deaminase comprises mutation H460Y. In some embodiments, the adenosine deaminase comprises mutation H460 W. In some embodiments, the adenosine deaminase comprises mutation H460Q. In some embodiments, the adenosine deaminase comprises mutation H460N. In some embodiments, the adenosine deaminase comprises mutation H460E. In some embodiments, the adenosine deaminase comprises mutation H460D. In some embodiments, the adenosine deaminase comprises mutation H460K. In some embodiments, the mutations at H460 described above are further made in combination with a E488Q mutation.

In some embodiments, the adenosine deaminase comprises a mutation at proline462 of the hADAR2-D amino acid sequence, or a corresponding position in a homologous ADAR protein. In some embodiments, the proline residue at position 462 is replaced by a serine residue (P462S). In some embodiments, the proline residue at position 462 is replaced by a tryptophan residue (P462 W). In some embodiments, the proline residue at position 462 is replaced by a glutamic acid residue (P462E).

In some embodiments, the adenosine deaminase comprises a mutation at aspartic acid469 of the hADAR2-D amino acid sequence, or a corresponding position in a homologous ADAR protein. In some embodiments, the aspartic acid residue at position 469 is replaced by a glutamine residue (D469Q). In some embodiments, the aspartic acid residue at position 469 is replaced by a serine residue (D469S). In some embodiments, the aspartic acid residue at position 469 is replaced by a tyrosine residue (D469Y).

In some embodiments, the adenosine deaminase comprises a mutation at arginine470 of the hADAR2-D amino acid sequence, or a corresponding position in a homologous ADAR protein. In some embodiments, the arginine residue at position 470 is replaced by an alanine residue (R470A). In some embodiments, the arginine residue at position 470 is replaced by an isoleucine residue (R470I). In some embodiments, the arginine residue at position 470 is replaced by an aspartic acid residue (R470D).

In some embodiments, the adenosine deaminase comprises a mutation at histidine471 of the hADAR2-D amino acid sequence, or a corresponding position in a homologous ADAR protein. In some embodiments, the histidine residue at position 471 is replaced by a lysine residue (H471K). In some embodiments, the histidine residue at position 471 is replaced by a threonine residue (H471T). In some embodiments, the histidine residue at position 471 is replaced by a valine residue (H471V).

In some embodiments, the adenosine deaminase comprises a mutation at proline472 of the hADAR2-D amino acid sequence, or a corresponding position in a homologous ADAR protein. In some embodiments, the proline residue at position 472 is replaced by a lysine residue (P472K). In some embodiments, the proline residue at position 472 is replaced by a threonine residue (P472T). In some embodiments, the proline residue at position 472 is replaced by an aspartic acid residue (P472D).

In some embodiments, the adenosine deaminase comprises a mutation at asparagine473 of the hADAR2-D amino acid sequence, or a corresponding position in a homologous ADAR protein. In some embodiments, the asparagine residue at position 473 is replaced by an arginine residue (N473R). In some embodiments, the asparagine residue at position 473 is replaced by a tryptophan residue (N473 W). In some embodiments, the asparagine residue at position 473 is replaced by a proline residue (N473P). In some embodiments, the asparagine residue at position 473 is replaced by an aspartic acid residue (N473D).

In some embodiments, the adenosine deaminase comprises a mutation at arginine 474 of the hADAR2-D amino acid sequence, or a corresponding position in a homologous ADAR protein. In some embodiments, the arginine residue at position 474 is replaced by a lysine residue (R474K). In some embodiments, the arginine residue at position 474 is replaced by a glycine residue (R474G). In some embodiments, the arginine residue at position 474 is replaced by an aspartic acid residue (R474D). In some embodiments, the arginine residue at position 474 is replaced by a glutamic acid residue (R474E).

In some embodiments, the adenosine deaminase comprises a mutation at lysine475 of the hADAR2-D amino acid sequence, or a corresponding position in a homologous ADAR protein. In some embodiments, the lysine residue at position 475 is replaced by a glutamine residue (K475Q). In some embodiments, the lysine residue at position 475 is replaced by an asparagine residue (K475N). In some embodiments, the lysine residue at position 475 is replaced by an aspartic acid residue (K475D).

In some embodiments, the adenosine deaminase comprises a mutation at alanine476 of the hADAR2-D amino acid sequence, or a corresponding position in a homologous ADAR protein. In some embodiments, the alanine residue at position 476 is replaced by a serine residue (A476S). In some embodiments, the alanine residue at position 476 is replaced by an arginine residue (A476R). In some embodiments, the alanine residue at position 476 is replaced by a glutamic acid residue (A476E).

In some embodiments, the adenosine deaminase comprises a mutation at arginine477 of the hADAR2-D amino acid sequence, or a corresponding position in a homologous ADAR protein. In some embodiments, the arginine residue at position 477 is replaced by a lysine residue (R477K). In some embodiments, the arginine residue at position 477 is replaced by a threonine residue (R477T). In some embodiments, the arginine residue at position 477 is replaced by a phenylalanine residue (R477F). In some embodiments, the arginine residue at position 474 is replaced by a glutamic acid residue (R477E).

In some embodiments, the adenosine deaminase comprises a mutation at glycine478 of the hADAR2-D amino acid sequence, or a corresponding position in a homologous ADAR protein. In some embodiments, the glycine residue at position 478 is replaced by an alanine residue (G478A). In some embodiments, the glycine residue at position 478 is replaced by an arginine residue (G478R). In some embodiments, the glycine residue at position 478 is replaced by a tyrosine residue (G478Y). In some embodiments, the adenosine deaminase comprises mutation G478I. In some embodiments, the adenosine deaminase comprises mutation G478L. In some embodiments, the adenosine deaminase comprises mutation G478V. In some embodiments, the adenosine deaminase comprises mutation G478F. In some embodiments, the adenosine deaminase comprises mutation G478M. In some embodiments, the adenosine deaminase comprises mutation G478C. In some embodiments, the adenosine deaminase comprises mutation G478P. In some embodiments, the adenosine deaminase comprises mutation G478T. In some embodiments, the adenosine deaminase comprises mutation G478S. In some embodiments, the adenosine deaminase comprises mutation G478 W. In some embodiments, the adenosine deaminase comprises mutation G478Q. In some embodiments, the adenosine deaminase comprises mutation G478N. In some embodiments, the adenosine deaminase comprises mutation G478H. In some embodiments, the adenosine deaminase comprises mutation G478E. In some embodiments, the adenosine deaminase comprises mutation G478D. In some embodiments, the adenosine deaminase comprises mutation G478K. In some embodiments, the mutations at G478 described above are further made in combination with a E488Q mutation.

In some embodiments, the adenosine deaminase comprises a mutation at glutamine479 of the hADAR2-D amino acid sequence, or a corresponding position in a homologous ADAR protein. In some embodiments, the glutamine residue at position 479 is replaced by an asparagine residue (Q479N). In some embodiments, the glutamine residue at position 479 is replaced by a serine residue (Q479S). In some embodiments, the glutamine residue at position 479 is replaced by a proline residue (Q479P).

In some embodiments, the adenosine deaminase comprises a mutation at arginine348 of the hADAR2-D amino acid sequence, or a corresponding position in a homologous ADAR protein. In some embodiments, the arginine residue at position 348 is replaced by an alanine residue (R348A). In some embodiments, the arginine residue at position 348 is replaced by a glutamic acid residue (R348E).

In some embodiments, the adenosine deaminase comprises a mutation at valine351 of the hADAR2-D amino acid sequence, or a corresponding position in a homologous ADAR protein. In some embodiments, the valine residue at position 351 is replaced by a leucine residue (V351L). In some embodiments, the adenosine deaminase comprises mutation V351Y. In some embodiments, the adenosine deaminase comprises mutation V351M. In some embodiments, the adenosine deaminase comprises mutation V351T. In some embodiments, the adenosine deaminase comprises mutation V351G. In some embodiments, the adenosine deaminase comprises mutation V351A. In some embodiments, the adenosine deaminase comprises mutation V351F. In some embodiments, the adenosine deaminase comprises mutation V351E. In some embodiments, the adenosine deaminase comprises mutation V351I. In some embodiments, the adenosine deaminase comprises mutation V351C. In some embodiments, the adenosine deaminase comprises mutation V351H. In some embodiments, the adenosine deaminase comprises mutation V351P. In some embodiments, the adenosine deaminase comprises mutation V351S. In some embodiments, the adenosine deaminase comprises mutation V351K. In some embodiments, the adenosine deaminase comprises mutation V351N. In some embodiments, the adenosine deaminase comprises mutation V351 W. In some embodiments, the adenosine deaminase comprises mutation V351Q. In some embodiments, the adenosine deaminase comprises mutation V351D. In some embodiments, the adenosine deaminase comprises mutation V351R. In some embodiments, the mutations at V351 described above are further made in combination with a E488Q mutation.

In some embodiments, the adenosine deaminase comprises a mutation at threonine375 of the hADAR2-D amino acid sequence, or a corresponding position in a homologous ADAR protein. In some embodiments, the threonine residue at position 375 is replaced by a glycine residue (T375G). In some embodiments, the threonine residue at position 375 is replaced by a serine residue (T375S). In some embodiments, the adenosine deaminase comprises mutation T375H. In some embodiments, the adenosine deaminase comprises mutation T375Q. In some embodiments, the adenosine deaminase comprises mutation T375C. In some embodiments, the adenosine deaminase comprises mutation T375N. In some embodiments, the adenosine deaminase comprises mutation T375M. In some embodiments, the adenosine deaminase comprises mutation T375A. In some embodiments, the adenosine deaminase comprises mutation T375 W. In some embodiments, the adenosine deaminase comprises mutation T375V. In some embodiments, the adenosine deaminase comprises mutation T375R. In some embodiments, the adenosine deaminase comprises mutation T375E. In some embodiments, the adenosine deaminase comprises mutation T375K. In some embodiments, the adenosine deaminase comprises mutation T375F. In some embodiments, the adenosine deaminase comprises mutation T375I. In some embodiments, the adenosine deaminase comprises mutation T375D. In some embodiments, the adenosine deaminase comprises mutation T375P. In some embodiments, the adenosine deaminase comprises mutation T375L. In some embodiments, the adenosine deaminase comprises mutation T375Y. In some embodiments, the mutations at T375Y described above are further made in combination with an E488Q mutation.

In some embodiments, the adenosine deaminase comprises a mutation at Arg481 of the hADAR2-D amino acid sequence, or a corresponding position in a homologous ADAR protein. In some embodiments, the arginine residue at position 481 is replaced by a glutamic acid residue (R481E).

In some embodiments, the adenosine deaminase comprises a mutation at Ser486 of the hADAR2-D amino acid sequence, or a corresponding position in a homologous ADAR protein. In some embodiments, the serine residue at position 486 is replaced by a threonine residue (S486T).

In some embodiments, the adenosine deaminase comprises a mutation at Thr490 of the hADAR2-D amino acid sequence, or a corresponding position in a homologous ADAR protein. In some embodiments, the threonine residue at position 490 is replaced by an alanine residue (T490A). In some embodiments, the threonine residue at position 490 is replaced by a serine residue (T490S).

In some embodiments, the adenosine deaminase comprises a mutation at Ser495 of the hADAR2-D amino acid sequence, or a corresponding position in a homologous ADAR protein. In some embodiments, the serine residue at position 495 is replaced by a threonine residue (S495T).

In some embodiments, the adenosine deaminase comprises a mutation at Arg510 of the hADAR2-D amino acid sequence, or a corresponding position in a homologous ADAR protein. In some embodiments, the arginine residue at position 510 is replaced by a glutamine residue (R510Q). In some embodiments, the arginine residue at position 510 is replaced by an alanine residue (R510A). In some embodiments, the arginine residue at position 510 is replaced by a glutamic acid residue (R510E).

In some embodiments, the adenosine deaminase comprises a mutation at Gly593 of the hADAR2-D amino acid sequence, or a corresponding position in a homologous ADAR protein. In some embodiments, the glycine residue at position 593 is replaced by an alanine residue (G593A). In some embodiments, the glycine residue at position 593 is replaced by a glutamic acid residue (G593E).

In some embodiments, the adenosine deaminase comprises a mutation at Lys594 of the hADAR2-D amino acid sequence, or a corresponding position in a homologous ADAR protein. In some embodiments, the lysine residue at position 594 is replaced by an alanine residue (K594A).

In some embodiments, the adenosine deaminase comprises a mutation at any one or more of positions A454, R455, 1456, F457, S458, P459, H460, P462, D469, R470, H471, P472, N473, R474, K475, A476, R477, G478, Q479, R348, R510, G593, K594 of the hADAR2-D amino acid sequence, or a corresponding position in a homologous ADAR protein.

In some embodiments, the adenosine deaminase comprises any one or more of mutations A454S, A454C, A454D, R455A, R455V, R455H, I456V, I456L, I456D, F457Y, F457R, F457E, S458V, S458F, S458P, P459C, P459H, P459 W, H460R, H460I, H460P, P462S, P462 W, P462E, D469Q, D469S, D469Y, R470A, R470I, R470D, H471K, H471T, H471V, P472K, P472T, P472D, N473R, N473 W, N473P, R474K, R474G, R474D, K475Q, K475N, K475D, A476S, A476R, A476E, R477K, R477T, R477F, G478A, G478R, G478Y, Q479N, Q479S, Q479P, R348A, R510Q, R510A, G593A, G593E, K594A of the hADAR2-D amino acid sequence, or a corresponding position in a homologous ADAR protein.

In certain embodiments the adenosine deaminase is mutated to convert the activity to cytidine deaminase. Accordingly in some embodiments, the adenosine deaminase comprises one or more mutations in positions selected from E396, C451, V351, R455, T375, K376, S486, Q488, R510, K594, R348, G593, S397, H443, L444, Y445, F442, E438, T448, A353, V355, T339, P539, T339, P539, V525 I520, P462 and N579. In particular embodiments, the adenosine deaminase comprises one or more mutations in a position selected from V351, L444, V355, V525 and I520. In some embodiments, the adenosine deaminase may comprise one or more of mutations at E488, V351, S486, T375, S370, P462, N597, based on amino acid sequence positions of hADAR2-D, and mutations in a homologous ADAR protein corresponding to the above.

In some embodiments, the adenosine deaminase may comprise one or more of the mutations: E488Q based on amino acid sequence positions of hADAR2-D, and mutations in a homologous ADAR protein corresponding to the above. In some embodiments, the adenosine deaminase may comprise one or more of the mutations: E488Q, V351G, based on amino acid sequence positions of hADAR2-D, and mutations in a homologous ADAR protein corresponding to the above. In some embodiments, the adenosine deaminase may comprise one or more of the mutations: E488Q, V351G, S486A, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and mutations in a homologous ADAR protein corresponding to the above. In some examples, provided herein includes a mutated adenosine deaminase e.g., an adenosine deaminase comprising one or more mutations of E488Q, V351G, S486A, T375S, S370C, P462A, N597I, L332I, I398V, K350I, M383L, D619G, S582T, V440I, S495N, K418E, S661T, fused with a dead Cas12b protein or Cas12 nickase. In a particular example, provided herein includes a mutated adenosine deaminase e.g., an adenosine deaminase comprising E488Q, V351G, S486A, T375S, S370C, P462A, N597I, L332I, 1398V, K350I, M383L, D619G, S582T, V440I, S495N, K418E, and S661T, fused with a dead Cas12b protein or a Cas12 nickase.

In some embodiments, the adenosine deaminase comprises a mutation at any one or more of positions T375, V351, G478, S458, H460 of the hADAR2-D amino acid sequence, or a corresponding position in a homologous ADAR protein, optionally in combination with a mutation at E488. In some embodiments, the adenosine deaminase comprises one or more of mutations selected from T375G, T375C, T375H, T375Q, V351M, V351T, V351Y, G478R, S458F, H460I, optionally in combination with E488Q.

In some embodiments, the adenosine deaminase comprises one or more of mutations selected from T375H, T375Q, V351M, V351Y, H460P, optionally in combination with E488Q.

In some embodiments, the adenosine deaminase comprises mutations T375S and S458F, optionally in combination with E488Q.

In some embodiments, the adenosine deaminase comprises a mutation at two or more of positions T375, N473, R474, G478, S458, P459, V351, R455, R455, T490, R348, Q479 of the hADAR2-D amino acid sequence, or a corresponding position in a homologous ADAR protein, optionally in combination with a mutation at E488. In some embodiments, the adenosine deaminase comprises two or more of mutations selected from T375G, T375S, N473D, R474E, G478R, S458F, P459 W, V351L, R455G, R455S, T490A, R348E, Q479P, optionally in combination with E488Q.

In some embodiments, the adenosine deaminase comprises mutations T375G and V351L. In some embodiments, the adenosine deaminase comprises mutations T375G and R455G. In some embodiments, the adenosine deaminase comprises mutations T375G and R455S. In some embodiments, the adenosine deaminase comprises mutations T375G and T490A. In some embodiments, the adenosine deaminase comprises mutations T375G and R348E. In some embodiments, the adenosine deaminase comprises mutations T375S and V351L. In some embodiments, the adenosine deaminase comprises mutations T375S and R455G. In some embodiments, the adenosine deaminase comprises mutations T375S and R455S. In some embodiments, the adenosine deaminase comprises mutations T375S and T490A. In some embodiments, the adenosine deaminase comprises mutations T375S and R348E. In some embodiments, the adenosine deaminase comprises mutations N473D and V351L. In some embodiments, the adenosine deaminase comprises mutations N473D and R455G. In some embodiments, the adenosine deaminase comprises mutations N473D and R455S. In some embodiments, the adenosine deaminase comprises mutations N473D and T490A. In some embodiments, the adenosine deaminase comprises mutations N473D and R348E. In some embodiments, the adenosine deaminase comprises mutations R474E and V351L. In some embodiments, the adenosine deaminase comprises mutations R474E and R455G. In some embodiments, the adenosine deaminase comprises mutations R474E and R455S. In some embodiments, the adenosine deaminase comprises mutations R474E and T490A. In some embodiments, the adenosine deaminase comprises mutations R474E and R348E. In some embodiments, the adenosine deaminase comprises mutations S458F and T375G. In some embodiments, the adenosine deaminase comprises mutations S458F and T375S. In some embodiments, the adenosine deaminase comprises mutations S458F and N473D. In some embodiments, the adenosine deaminase comprises mutations S458F and R474E. In some embodiments, the adenosine deaminase comprises mutations S458F and G478R. In some embodiments, the adenosine deaminase comprises mutations G478R and T375G. In some embodiments, the adenosine deaminase comprises mutations G478R and T375S. In some embodiments, the adenosine deaminase comprises mutations G478R and N473D. In some embodiments, the adenosine deaminase comprises mutations G478R and R474E. In some embodiments, the adenosine deaminase comprises mutations P459 W and T375G. In some embodiments, the adenosine deaminase comprises mutations P459 W and T375S. In some embodiments, the adenosine deaminase comprises mutations P459 W and N473D. In some embodiments, the adenosine deaminase comprises mutations P459 W and R474E. In some embodiments, the adenosine deaminase comprises mutations P459 W and G478R. In some embodiments, the adenosine deaminase comprises mutations P459 W and S458F. In some embodiments, the adenosine deaminase comprises mutations Q479P and T375G. In some embodiments, the adenosine deaminase comprises mutations Q479P and T375S. In some embodiments, the adenosine deaminase comprises mutations Q479P and N473D. In some embodiments, the adenosine deaminase comprises mutations Q479P and R474E. In some embodiments, the adenosine deaminase comprises mutations Q479P and G478R. In some embodiments, the adenosine deaminase comprises mutations Q479P and S458F. In some embodiments, the adenosine deaminase comprises mutations Q479P and P459 W. All mutations described in this paragraph may also further be made in combination with an E488Q mutation.

In some embodiments, the adenosine deaminase comprises a mutation at any one or more of positions K475, Q479, P459, G478, S458 of the hADAR2-D amino acid sequence, or a corresponding position in a homologous ADAR protein, optionally in combination with a mutation at E488. In some embodiments, the adenosine deaminase comprises one or more of mutations selected from K475N, Q479N, P459 W, G478R, S458P, S458F, optionally in combination with E488Q.

In some embodiments, the adenosine deaminase comprises a mutation at any one or more of positions T375, V351, R455, H460, A476 of the hADAR2-D amino acid sequence, or a corresponding position in a homologous ADAR protein, optionally in combination with a mutation at E488. In some embodiments, the adenosine deaminase comprises one or more of mutations selected from T375G, T375C, T375H, T375Q, V351M, V351T, V351Y, R455H, H460P, H460I, A476E, optionally in combination with E488Q.

In certain embodiments, improvement of editing and reduction of off-target modification is achieved by chemical modification of gRNAs. gRNAs which are chemically modified as exemplified in Vogel et al. (2014), Angew Chem Int Ed, 53:6267-6271, doi:10.1002/anie.201402634 (incorporated herein by reference in its entirety) reduce off-target activity and improve on-target efficiency. 2'-O-methyl and phosphothioate modified guide RNAs in general improve editing efficiency in cells.

ADAR has been known to demonstrate a preference for neighboring nucleotides on either side of the edited A (nature.com/nsmb/journal/v23/n5/full/nsmb.3203.html, Matthews et al. (2017), Nature Structural Mol Biol, 23(5): 426-433, incorporated herein by reference in its entirety). Accordingly, in certain embodiments, the gRNA, target, and/or ADAR is selected optimized for motif preference.

Intentional mismatches have been demonstrated in vitro to allow for editing of non-preferred motifs (academic.oup-.com/nar/article-lookup/doi/10.1093/nar/gku272; Schneider et al (2014), Nucleic Acid Res, 42(10):e87); Fukuda et al. (2017), Scientific Reports, 7, doi:10.1038/srep41478, incorporated herein by reference in its entirety). Accordingly, in certain embodiments, to enhance RNA editing efficiency on non-preferred 5' or 3' neighboring bases, intentional mismatches in neighboring bases are introduced.

In some embodiments, the adenosine deaminase may be a tRNA-specific adenosine deaminase or a variant thereof. In some embodiments, the adenosine deaminase may comprise one or more of the mutations: W23L, W23R, R26G, H36L, N37S, P48S, P48T, P48A, I49V, R51L, N72D, L84F, S97C, A106V, D108N, H123Y, G125A, A142N, S146C, D147Y, R152H, R152P, E155V, I156F, K157N, K161T, based on amino acid sequence positions of *E. coli* TadA, and mutations in a homologous deaminase protein corresponding to the above. In some embodiments, the adenosine deaminase may comprise one or more of the mutations: D108N based on amino acid sequence positions of *E. coli* TadA, and mutations in a homologous deaminase protein corresponding to the above. In some embodiments, the adenosine deaminase may comprise one or more of the mutations: A106V, D108N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, based on amino acid sequence positions of *E. coli* TadA, and mutations in a homologous deaminase protein corresponding to the above. In some embodiments, the adenosine deaminase may comprise one or more of the mutations: A106V, D108N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, A142N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, A142N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, A142N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, A142N, based on amino acid sequence positions of *E. coli* TadA, and mutations in a homologous deaminase protein corresponding to the above.

Results suggest that A's opposite C's in the targeting window of the ADAR deaminase domain are preferentially edited over other bases. Additionally, A's base-paired with U's within a few bases of the targeted base show low levels of editing by Cas12b-ADAR fusions, suggesting that there is flexibility for the enzyme to edit multiple A's. These two observations suggest that multiple A's in the activity window of Cas12b-ADAR fusions could be specified for editing by mismatching all A's to be edited with C's. Accordingly, in certain embodiments, multiple A:C mismatches in the activity window are designed to create multiple A:I edits. In certain embodiments, to suppress potential off-target editing in the activity window, non-target A's are paired with A's or G's.

The terms "editing specificity" and "editing preference" are used interchangeably herein to refer to the extent of A-to-I editing at a particular adenosine site in a double-stranded substrate. In some embodiments, the substrate editing preference is determined by the 5' nearest neighbor and/or the 3' nearest neighbor of the target adenosine residue. In some embodiments, the adenosine deaminase has preference for the 5' nearest neighbor of the substrate ranked as U>A>C>G (">" indicates greater preference). In some embodiments, the adenosine deaminase has preference for the 3' nearest neighbor of the substrate ranked as G>C~A>U (">" indicates greater preference; "~" indicates similar preference). In some embodiments, the adenosine deaminase has preference for the 3' nearest neighbor of the substrate ranked as G>C>U~A (">" indicates greater preference; "~" indicates similar preference). In some embodiments, the adenosine deaminase has preference for the 3' nearest neighbor of the substrate ranked as G>C>A>U (">" indicates greater preference). In some embodiments, the adenosine deaminase has preference for the 3' nearest neighbor of the substrate ranked as C~G~A>U (">" indicates greater preference; "~" indicates similar preference). In some embodiments, the adenosine deaminase has preference for a triplet sequence containing the target adenosine residue ranked as TAG>AAG>CAC>AAT>GAA>GAC (">" indicates greater preference), the center A being the target adenosine residue.

In some embodiments, the substrate editing preference of an adenosine deaminase is affected by the presence or absence of a nucleic acid binding domain in the adenosine deaminase protein. In some embodiments, to modify substrate editing preference, the deaminase domain is connected with a double-strand RNA binding domain (dsRBD) or a double-strand RNA binding motif (dsRBM). In some embodiments, the dsRBD or dsRBM may be derived from an ADAR protein, such as hADAR1 or hADAR2. In some embodiments, a full length ADAR protein that comprises at least one dsRBD and a deaminase domain is used. In some embodiments, the one or more dsRBM or dsRBD is at the N-terminus of the deaminase domain. In other embodiments, the one or more dsRBM or dsRBD is at the C-terminus of the deaminase domain.

In some embodiments, the substrate editing preference of an adenosine deaminase is affected by amino acid residues near or in the active center of the enzyme. In some embodiments, to modify substrate editing preference, the adenosine deaminase may comprise one or more of the mutations: G336D, G487R, G487K, G487 W, G487Y, E488Q, E488N, T490A, V493A, V493T, V493S, N597K, N597R, A589V, S599T, N613K, N613R, based on amino acid sequence positions of hADAR2-D, and mutations in a homologous ADAR protein corresponding to the above.

Particularly, in some embodiments, to reduce editing specificity, the adenosine deaminase can comprise one or more of mutations E488Q, V493A, N597K, N613K, based on amino acid sequence positions of hADAR2-D, and mutations in a homologous ADAR protein corresponding to the above. In some embodiments, to increase editing specificity, the adenosine deaminase can comprise mutation T490A.

In some embodiments, to increase editing preference for target adenosine (A) with an immediate 5' G, such as substrates comprising the triplet sequence GAC, the center A being the target adenosine residue, the adenosine deaminase can comprise one or more of mutations G336D, E488Q, E488N, V493T, V493S, V493A, A589V, N597K, N597R, S599T, N613K, N613R, based on amino acid sequence positions of hADAR2-D, and mutations in a homologous ADAR protein corresponding to the above.

Particularly, in some embodiments, the adenosine deaminase comprises mutation E488Q or a corresponding mutation in a homologous ADAR protein for editing substrates comprising the following triplet sequences: GAC, GAA, GAU, GAG, CAU, AAU, UAC, the center A being the target adenosine residue.

In some embodiments, the adenosine deaminase comprises the wild-type amino acid sequence of hADAR1-D. In some embodiments, the adenosine deaminase comprises one or more mutations in the hADAR1-D sequence, such that the editing efficiency, and/or substrate editing preference of hADAR1-D is changed according to specific needs.

In some embodiments, the adenosine deaminase comprises a mutation at Glycine1007 of the hADAR1-D amino acid sequence, or a corresponding position in a homologous ADAR protein. In some embodiments, the glycine residue at position 1007 is replaced by a non-polar amino acid residue with relatively small side chains. For example, in some embodiments, the glycine residue at position 1007 is replaced by an alanine residue (G1007A). In some embodiments, the glycine residue at position 1007 is replaced by a valine residue (G1007V). In some embodiments, the glycine residue at position 1007 is replaced by an amino acid residue with relatively large side chains. In some embodiments, the glycine residue at position 1007 is replaced by an arginine residue (G1007R). In some embodiments, the glycine residue at position 1007 is replaced by a lysine residue (G1007K). In some embodiments, the glycine residue at position 1007 is replaced by a tryptophan residue (G1007 W). In some embodiments, the glycine residue at position 1007 is replaced by a tyrosine residue (G1007Y). Additionally, in other embodiments, the glycine residue at position 1007 is replaced by a leucine residue (G1007L). In other embodiments, the glycine residue at position 1007 is replaced by a threonine residue (G1007T). In other embodiments, the glycine residue at position 1007 is replaced by a serine residue (G1007S).

In some embodiments, the adenosine deaminase comprises a mutation at glutamic acid1008 of the hADAR1-D amino acid sequence, or a corresponding position in a homologous ADAR protein. In some embodiments, the glutamic acid residue at position 1008 is replaced by a polar amino acid residue having a relatively large side chain. In some embodiments, the glutamic acid residue at position 1008 is replaced by a glutamine residue (E1008Q). In some embodiments, the glutamic acid residue at position 1008 is replaced by a histidine residue (E1008H). In some embodiments, the glutamic acid residue at position 1008 is replaced by an arginine residue (E1008R). In some embodiments, the glutamic acid residue at position 1008 is replaced by a lysine residue (E1008K). In some embodiments, the glutamic acid residue at position 1008 is replaced by a nonpolar or small polar amino acid residue. In some embodiments, the glutamic acid residue at position 1008 is replaced by a phenylalanine residue (E1008F). In some embodiments, the glutamic acid residue at position 1008 is replaced by a tryptophan residue (E1008 W). In some embodiments, the glutamic acid residue at position 1008 is replaced by a glycine residue (E1008G). In some embodiments, the glutamic acid residue at position 1008 is replaced by an isoleucine residue (E1008I). In some embodiments, the glutamic acid residue at position 1008 is replaced by a valine residue (E1008V). In some embodiments, the glutamic acid residue at position 1008 is replaced by a proline residue (E1008P). In some embodiments, the glutamic acid residue at position 1008 is replaced by a serine residue (E1008S). In other embodiments, the glutamic acid residue at position 1008 is replaced by an asparagine residue (E1008N). In other embodiments, the glutamic acid residue at position 1008 is replaced by an alanine residue (E1008A). In other embodiments, the glutamic acid residue at position 1008 is replaced by a Methionine residue (E1008M). In some embodiments, the glutamic acid residue at position 1008 is replaced by a leucine residue (E1008L).

In some embodiments, to improve editing efficiency, the adenosine deaminase may comprise one or more of the mutations: E1007S, E1007A, E1007V, E1008Q, E1008R, E1008H, E1008M, E1008N, E1008K, based on amino acid sequence positions of hADAR1-D, and mutations in a homologous ADAR protein corresponding to the above.

In some embodiments, to reduce editing efficiency, the adenosine deaminase may comprise one or more of the mutations: E1007R, E1007K, E1007Y, E1007L, E1007T, E1008G, E1008I, E1008P, E1008V, E1008F, E1008 W, E1008S, E1008N, E1008K, based on amino acid sequence positions of hADAR1-D, and mutations in a homologous ADAR protein corresponding to the above.

In some embodiments, the substrate editing preference, efficiency and/or selectivity of an adenosine deaminase is affected by amino acid residues near or in the active center of the enzyme. In some embodiments, the adenosine deaminase comprises a mutation at the glutamic acid 1008 position in hADAR1-D sequence, or a corresponding position in a homologous ADAR protein. In some embodiments, the mutation is E1008R, or a corresponding mutation in a homologous ADAR protein. In some embodiments, the E1008R mutant has an increased editing efficiency for target adenosine residue that has a mismatched G residue on the opposite strand.

In some embodiments, the adenosine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the adenosine deaminase and the double-stranded substrate is mediated by one or more additional protein factor(s), including a CRISPR/CAS protein factor. In some embodiments, the interaction between the adenosine deaminase and the double-stranded substrate is further mediated by one or more nucleic acid component(s), including a guide RNA.

Modified Adenosine Deaminase Having C to U Deamination Activity

In certain example embodiments, directed evolution may be used to design modified ADAR proteins capable of catalyzing additional reactions besides deamination of an adenine to a hypoxanthine. For example, the modified ADAR protein may be capable of catalyzing deamination of a cytidine to an uracil. While not bound by a particular theory, mutations that improve C to U activity may alter the shape of the binding pocket to be more amenable to the smaller cytidine base.

In some embodiments, the modified adenosine deaminase having C-to-U deamination activity comprises a mutation at any one or more of positions V351, T375, R455, and E488 of the hADAR2-D amino acid sequence, or a corresponding position in a homologous ADAR protein. In some embodiments, the adenosine deaminase comprises mutation E488Q. In some embodiments, the adenosine deaminase comprises one or more of mutations selected from V351I, V351L, V351F, V351M, V351C, V351A, V351G, V351P, V351T, V351S, V351Y, V351 W, V351Q, V351N, V351H, V351E, V351D, V351K, V351R, T375I, T375L, T375V, T375F, T375M, T375C, T375A, T375G, T375P, T375S, T375Y, T375 W, T375Q, T375N, T375H, T375E, T375D, T375K, T375R, R455I, R455L, R455V, R455F, R455M, R455C, R455A, R455G, R455P, R455T, R455S, R455Y, R455 W, R455Q, R455N, R455H, R455E, R455D, R455K. In some embodiments, the adenosine deaminase comprises mutation E488Q, and further comprises one or more of mutations selected from V351I, V351L, V351F, V351M, V351C, V351A, V351G, V351P, V351T, V351S, V351Y, V351 W, V351Q, V351N, V351H, V351E, V351D, V351K, V351R, T375I, T375L, T375V, T375F, T375M, T375C, T375A, T375G, T375P, T375S, T375Y, T375 W, T375Q, T375N, T375H, T375E, T375D, T375K, T375R, R455I, R455L, R455V, R455F, R455M, R455C, R455A, R455G, R455P, R455T, R455S, R455Y, R455 W, R455Q, R455N, R455H, R455E, R455D, R455K.

In connection with the aforementioned modified ADAR protein having C-to-U deamination activity, the invention described herein also relates to a method for deaminating a C in a target RNA sequence of interest, comprising delivering to a target RNA or DNA an AD-functionalized composition disclosed herein.

In certain example embodiments, the method for deaminating a C in a target RNA sequence comprises delivering to said target RNA: (a) a catalytically inactive (dead) Cas; (b) a guide molecule which comprises a guide sequence linked to a direct repeat sequence; and (c) a modified ADAR protein having C-to-U deamination activity or catalytic domain thereof, wherein said modified ADAR protein or catalytic domain thereof is covalently or non-covalently linked to said dead Cas protein or said guide molecule or is adapted to link thereto after delivery; wherein guide molecule forms a complex with said dead Cas protein and directs said complex to bind said target RNA sequence of interest; wherein said guide sequence is capable of hybridizing with a target sequence comprising said C to form an RNA duplex; wherein, optionally, said guide sequence comprises a non-pairing A or U at a position corresponding to said C resulting in a mismatch in the RNA duplex formed; and wherein said modified ADAR protein or catalytic domain thereof deaminates said C in said RNA duplex.

In connection with the aforementioned modified ADAR protein having C-to-U deamination activity, the invention described herein further relates to an engineered, non-naturally occurring system suitable for deaminating a C in a target locus of interest, comprising: (a) a guide molecule which comprises a guide sequence linked to a direct repeat sequence, or a nucleotide sequence encoding said guide molecule; (b) a catalytically inactive Cas13 protein, or a nucleotide sequence encoding said catalytically inactive Cas13 protein; and (c) a modified ADAR protein having C-to-U deamination activity or catalytic domain thereof, or a nucleotide sequence encoding said modified ADAR protein or catalytic domain thereof, wherein said modified ADAR protein or catalytic domain thereof is covalently or non-covalently linked to said Cas13 protein or said guide molecule or is adapted to link thereto after delivery; wherein said guide sequence is capable of hybridizing with a target RNA sequence comprising a C to form an RNA duplex; wherein, optionally, said guide sequence comprises a non-pairing A or U at a position corresponding to said C resulting in a mismatch in the RNA duplex formed; wherein, optionally, the system is a vector system comprising one or more vectors comprising: (a) a first regulatory element operably linked to a nucleotide sequence encoding said guide molecule which comprises said guide sequence, (b) a second regulatory element operably linked to a nucleotide sequence encoding said catalytically inactive Cas13 protein; and (c) a nucleotide sequence encoding a modified ADAR protein having C-to-U deamination activity or catalytic domain thereof which is under control of said first or second regulatory element or operably linked to a third regulatory element; wherein, if said nucleotide sequence encoding a modified ADAR protein or catalytic domain thereof is operably linked to a third regulatory element, said modified ADAR protein or catalytic domain thereof is adapted to link to said guide molecule or said Cas13 protein after expression; wherein components (a), (b) and (c) are located on the same or different vectors of the system, optionally wherein said first, second, and/or third regulatory element is an inducible promoter.

In an embodiment of the invention, the substrate of the adenosine deaminase is an RNA/DNA heteroduplex formed upon binding of the guide molecule to its DNA target which then forms the CRISPR-Cas complex with the CRISPR-Cas enzyme. The RNA/DNA or DNA/RNA heteroduplex is also referred to herein as the "RNA/DNA hybrid", "DNA/RNA hybrid" or "double-stranded substrate".

According to the present invention, the substrate of the adenosine deaminase is an RNA/DNAn RNA duplex formed upon binding of the guide molecule to its DNA target which then forms the CRISPR-Cas complex with the CRISPR-Cas enzyme. The substrate of the adenosine deaminase can also be an RNA/RNA duplex formed upon binding of the guide molecule to its RNA target which then forms the CRISPR-Cas complex with the CRISPR-Cas enzyme. The RNA/DNA or DNA/RNAn RNA duplex is also referred to herein as the "RNA/DNA hybrid", "DNA/RNA hybrid" or "double-stranded substrate". The particular features of the guide molecule and CRISPR-Cas enzyme are detailed below.

The term "editing selectivity" as used herein refers to the fraction of all sites on a double-stranded substrate that is edited by an adenosine deaminase. Without being bound by theory, it is contemplated that editing selectivity of an adenosine deaminase is affected by the double-stranded substrate's length and secondary structures, such as the presence of mismatched bases, bulges and/or internal loops.

In some embodiments, when the substrate is a perfectly base-paired duplex longer than 50 bp, the adenosine deaminase may be able to deaminate multiple adenosine residues within the duplex (e.g., 50% of all adenosine residues). In some embodiments, when the substrate is shorter than 50 bp, the editing selectivity of an adenosine deaminase is affected by the presence of a mismatch at the target adenosine site. Particularly, in some embodiments, adenosine (A) residue having a mismatched cytidine (C) residue on the opposite strand is deaminated with high efficiency. In some embodiments, adenosine (A) residue having a mismatched guanosine (G) residue on the opposite strand is skipped without editing.

In particular embodiments, the adenosine deaminase protein or catalytic domain thereof is delivered to the cell or expressed within the cell as a separate protein but is modified so as to be able to link to either the C2c1 protein or the guide molecule. In particular embodiments, this is ensured by the use of orthogonal RNA-binding protein or adaptor protein/aptamer combinations that exist within the diversity of bacteriophage coat proteins. Examples of such coat proteins include but are not limited to: MS2, Qβ, F2, GA, fr, JP501, M12, R17, BZ13, JP34, JP500, KU1, M11, MX1, TW18, VK, SP, FI, ID2, NL95, TW19, AP205, #Cb5, #Cb8r, #Cb12r, #Cb23r, 7s and PRR1. Aptamers can be naturally occurring or synthetic oligonucleotides that have been engineered through repeated rounds of in vitro selection or SELEX (systematic evolution of ligands by exponential enrichment) to bind to a specific target.

In particular embodiments, the guide molecule is provided with one or more distinct RNA loop(s) or distinct sequence(s) that can recruit an adaptor protein. A guide molecule may be extended, without colliding with the C2c1 protein by the insertion of distinct RNA loop(s) or distinct sequence(s) that may recruit adaptor proteins that can bind to the distinct RNA loop(s) or distinct sequence(s). Examples of modified guides and their use in recruiting effector domains to the C2c1 complex are provided in Konermann (Nature 2015, 517(7536): 583-588). In particular embodiments, the aptamer is a minimal hairpin aptamer which selectively binds dimerized MS2 bacteriophage coat proteins in mammalian cells and is introduced into the guide molecule, such as in the stemloop and/or in a tetraloop. In these embodiments, the adenosine deaminase protein is fused to MS2. The adenosine deaminase protein is then co-delivered together with the C2c1 protein and corresponding guide RNA.

In some embodiments, the C2c1-ADAR base editing system described herein comprises (a) a C2c1 protein, which is catalytically inactive or a nickase; (b) a guide molecule which comprises a guide sequence; and (c) an adenosine deaminase protein or catalytic domain thereof; wherein the adenosine deaminase protein or catalytic domain thereof is covalently or non-covalently linked to the C2c1 protein or the guide molecule or is adapted to link thereto after delivery; wherein the guide sequence is substantially complementary to the target sequence but comprises a non-pairing C corresponding to the A being targeted for deamination, resulting in a A-C mismatch in a DNA-RNA or RNA-RNA duplex formed by the guide sequence and the target sequence. For application in eukaryotic cells, the C2c1 protein and/or the adenosine deaminase are preferably NLS-tagged.

In some embodiments, the components (a), (b) and (c) are delivered to the cell as a ribonucleoprotein complex. The ribonucleoprotein complex can be delivered via one or more lipid nanoparticles.

In some embodiments, the components (a), (b) and (c) are delivered to the cell as one or more RNA molecules, such as one or more guide RNAs and one or more mRNA molecules encoding the C2c1 protein, the adenosine deaminase protein, and optionally the adaptor protein. The RNA molecules can be delivered via one or more lipid nanoparticles.

In some embodiments, the components (a), (b) and (c) are delivered to the cell as one or more DNA molecules. In some embodiments, the one or more DNA molecules are comprised within one or more vectors such as viral vectors (e.g., AAV). In some embodiments, the one or more DNA molecules comprise one or more regulatory elements operably configured to express the C2c1 protein, the guide molecule, and the adenosine deaminase protein or catalytic domain thereof, optionally wherein the one or more regulatory elements comprise inducible promoters.

In some embodiments, the guide molecule is capable of hybridizing with a target sequence comprising the Adenine to be deaminated within a first DNA strand or an RNA strand at the target locus to form a DNA-RNA or RNA-RNA duplex which comprises a non-pairing Cytosine opposite to said Adenine. Upon duplex formation, the guide molecule forms a complex with the C2c1 protein and directs the complex to bind said first DNA strand or said RNA strand at the target locus of interest. Details on the aspect of the guide of the C2c1-ADAR base editing system are provided herein below.

In some embodiments, a C2c1 guide RNA having a canonical length (e.g., about 20 nt for AacC2c1) is used to form a DNA-RNA or RNA-RNA duplex with the target DNA or RNA. In some embodiments, a C2c1 guide molecule longer than the canonical length (e.g., >20 nt for AacC2c1) is used to form a DNA-RNA or RNA-RNA duplex with the target DNA or RNA including outside of the C2c1-guide RNA-target DNA complex. In certain example embodiments, the guide sequence has a length of about 29-53 nt capable of forming a DNA-RNA or RNA-RNA duplex with said target sequence. In certain other example embodiments, the guide sequence has a length of about 40-50 nt capable of forming a DNA-RNA or RNA-RNA duplex with said target sequence. In certain example embodiments, the distance between said non-pairing C and the 5' end of said guide sequence is 20-30 nucleotides. In certain example embodiments, the distance between said non-pairing C and the 3' end of said guide sequence is 20-30 nucleotides.

In at least a first design, the C2c1-ADAR system comprises (a) an adenosine deaminase fused or linked to a C2c1 protein, wherein the C2c1 protein is catalytically inactive or a nickase, and (b) a guide molecule comprising a guide sequence designed to introduce a A-C mismatch in a DNA-RNA or RNA-RNA duplex formed between the guide sequence and the target sequence. In some embodiments, the C2c1 protein and/or the adenosine deaminase are NLS-tagged, on either the N- or C-terminus or both.

In at least a second design, the C2c1-ADAR system comprises (a) a C2c1 protein that is catalytically inactive or a nickase, (b) a guide molecule comprising a guide sequence designed to introduce a A-C mismatch in a DNA-RNA or RNA-RNA duplex formed between the guide sequence and the target sequence, and an aptamer sequence (e.g., MS2 RNA motif or PP7 RNA motif) capable of binding to an adaptor protein (e.g., MS2 coating protein or PP7 coat protein), and (c) an adenosine deaminase fused or linked to an adaptor protein, wherein the binding of the aptamer and the adaptor protein recruits the adenosine deaminase to the DNA-RNA or RNA-RNA duplex formed between the guide sequence and the target sequence for targeted deamination at the A of the A-C mismatch. In some embodiments, the adaptor protein and/or the adenosine deaminase are NLS-tagged, on either the N- or C-terminus or both. The C2c1 protein can also be NLS-tagged.

The use of different aptamers and corresponding adaptor proteins also allows orthogonal gene editing to be implemented. In one example in which adenosine deaminase is used in combination with cytidine deaminase for orthogonal gene editing/deamination, sgRNA targeting different loci are modified with distinct RNA loops in order to recruit MS2-adenosine deaminase and PP7-cytidine deaminase (or PP7-adenosine deaminase and MS2-cytidine deaminase), respectively, resulting in orthogonal deamination of A or C at the target loci of interest, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-adenosine deaminase, while another sgRNA targeting locus B can be modified with PP7 loops, recruiting PP7-cytidine deaminase. In the same cell, orthogonal, locus-specific modifications are thus realized. This principle can be extended to incorporate other orthogonal RNA-binding proteins.

In at least a third design, the C2c1-ADAR CRISPR system comprises (a) an adenosine deaminase inserted into an internal loop or unstructured region of a C2c1 protein, wherein the C2c1 protein is catalytically inactive or a nickase, and (b) a guide molecule comprising a guide sequence designed to introduce a A-C mismatch in a DNA-RNA or RNA-RNA duplex formed between the guide sequence and the target sequence.

C2c1 protein split sites that are suitable for insertion of adenosine deaminase can be identified with the help of a crystal structure. For example, with respect to AacC2c1 mutants, it should be readily apparent what the corresponding position for, for example, a sequence alignment. For other C2c1 protein, one can use the crystal structure of an ortholog if a relatively high degree of homology exists between the ortholog and the intended C2c1 protein.

The split position may be located within a region or loop. Preferably, the split position occurs where an interruption of the amino acid sequence does not result in the partial or full destruction of a structural feature (e.g., alpha-helixes or β-sheets). Unstructured regions (regions that did not show up in the crystal structure because these regions are not structured enough to be "frozen" in a crystal) are often preferred options. Splits in all unstructured regions that are exposed on the surface of C2c1 are envisioned in the practice of the invention. The positions within the unstructured regions or outside loops may not need to be exactly the numbers provided above, but may vary by, for example 1, 2, 3, 4, 5, 6, 7, 8, 9, or even 10 amino acids either side of the position given above, depending on the size of the loop, so long as the split position still falls within an unstructured region of outside loop.

The C2c1-ADAR system described herein can be used to target a specific Adenine within a DNA sequence for deamination. For example, the guide molecule can form a complex with the C2c1 protein and directs the complex to bind a target sequence at the target locus of interest. Because the guide sequence is designed to have a non-pairing C, the heteroduplex formed between the guide sequence and the target sequence comprises a A-C mismatch, which directs the adenosine deaminase to contact and deaminate the A opposite to the non-pairing C, converting it to an Inosine (I). Since Inosine (I) base pairs with C and functions like G in cellular process, the targeted deamination of A described herein is useful for correction of undesirable G-A and C-T mutations, as well as for obtaining desirable A-G and T-C mutations.

Base Excision Repair Inhibitor

In some embodiments, the AD-functionalized CRISPR system further comprises a base excision repair (BER) inhibitor. Without wishing to be bound by any particular theory, cellular DNA-repair response to the presence of I:T pairing may be responsible for a decrease in nucleobase editing efficiency in cells. Alkyladenine DNA glycosylase (also known as DNA-3-methyladenine glycosylase, 3-alkyladenine DNA glycosylase, or N-methylpurine DNA glycosylase) catalyzes removal of hypoxanthine from DNA in cells, which may initiate base excision repair, with reversion of the I:T pair to an A:T pair as outcome.

In some embodiments, the BER inhibitor is an inhibitor of alkyladenine DNA glycosylase. In some embodiments, the BER inhibitor is an inhibitor of human alkyladenine DNA glycosylase. In some embodiments, the BER inhibitor is a polypeptide inhibitor. In some embodiments, the BER inhibitor is a protein that binds hypoxanthine. In some embodiments, the BER inhibitor is a protein that binds hypoxanthine in DNA. In some embodiments, the BER inhibitor is a catalytically inactive alkyladenine DNA glycosylase protein or binding domain thereof. In some embodiments, the BER inhibitor is a catalytically inactive alkyladenine DNA glycosylase protein or binding domain thereof that does not excise hypoxanthine from the DNA. Other proteins that are capable of inhibiting (e.g., sterically blocking) an alkyladenine DNA glycosylase base-excision repair enzyme are within the scope of this disclosure. Additionally, any proteins that block or inhibit base-excision repair are also within the scope of this disclosure.

Without wishing to be bound by any particular theory, base excision repair may be inhibited by molecules that bind the edited strand, block the edited base, inhibit alkyladenine DNA glycosylase, inhibit base excision repair, protect the edited base, and/or promote fixing of the non-edited strand. It is believed that the use of the BER inhibitor described herein can increase the editing efficiency of an adenosine deaminase that is capable of catalyzing an A to I change.

Accordingly, in the first design of the AD-functionalized CRISPR system discussed above, the CRISPR-Cas protein or the adenosine deaminase can be fused to or linked to a BER inhibitor (e.g., an inhibitor of alkyladenine DNA glycosylase). In some embodiments, the BER inhibitor can be comprised in one of the following structures (nC2c1=C2c1 nickase; dC2c1=dead C2c1):

[AD]-[optional linker]-[nC2c1/dC2c1]-[optional linker]-[BER inhibitor];

[AD]-[optional linker]-[BER inhibitor]-[optional linker]-[nC2c1/dC2c1];

[BER inhibitor]-[optional linker]-[AD]-[optional linker]-[nC2c1/dC2c1];

[BER inhibitor]-[optional linker]-[nC2c1/dC2c1]-[optional linker]-[AD];

[nC2c1/dC2c1]-[optional linker]-[AD]-[optional linker]-[BER inhibitor];

[nC2c1/dC2c1]-[optional linker]-[BER inhibitor]-[optional linker]-[AD].

Similarly, in the second design of the AD-functionalized CRISPR system discussed above, the CRISPR-Cas protein, the adenosine deaminase, or the adaptor protein can be fused to or linked to a BER inhibitor (e.g., an inhibitor of alkyladenine DNA glycosylase). In some embodiments, the BER inhibitor can be comprised in one of the following structures (nC2c1=C2c1 nickase; dC2c1=dead C2c1):

[nC2c1/dC2c1]-[optional linker]-[BER inhibitor];

[BER inhibitor]-[optional linker]-[nC2c1/dC2c1];

[AD]-[optional linker]-[Adaptor]-[optional linker]-[BER inhibitor];

[AD]-[optional linker]-[BER inhibitor]-[optional linker]-[Adaptor];

[BER inhibitor]-[optional linker]-[AD]-[optional linker]-[Adaptor];

[BER inhibitor]-[optional linker]-[Adaptor]-[optional linker]-[AD];

[Adaptor]-[optional linker]-[AD]-[optional linker]-[BER inhibitor];

[Adaptor]-[optional linker]-[BER inhibitor]-[optional linker]-[AD].

In the third design of the AD-functionalized CRISPR system discussed above, the BER inhibitor can be inserted into an internal loop or unstructured region of a CRISPR-Cas protein.

Cytidine Deaminase

In some embodiments, the deaminase is a cytidine deaminase. The term "cytidine deaminase" or "cytidine deaminase protein" as used herein refers to a protein, a polypeptide, or one or more functional domain(s) of a protein or a polypeptide that is capable of catalyzing a hydrolytic deamination reaction that converts a cytosine (or a cytosine moiety of a molecule) to a uracil (or a uracil moiety of a molecule), as shown below. In some embodiments, the cytosine-containing molecule is a cytidine (C), and the uracil-containing molecule is a uridine (U). The cytosine-containing molecule can be deoxyribonucleic acid (DNA) or ribonucleic acid (RNA).

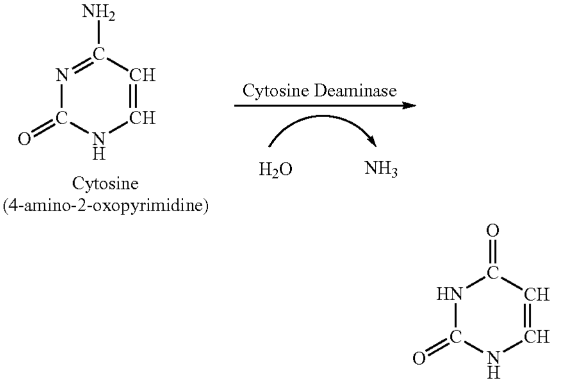

Cytosine (4-amino-2-oxopyrimidine)

Uracil (2,4-dioxopyrimidine)

According to the present disclosure, cytidine deaminases that can be used in connection with the present disclosure include, but are not limited to, members of the enzyme family known as apolipoprotein B mRNA-editing complex (APOBEC) family deaminase, an activation-induced deaminase (AID), or a cytidine deaminase 1 (CDA1). In particular embodiments, the deaminase in an APOBEC1 deaminase, an APOBEC2 deaminase, an APOBEC3A deaminase, an APOBEC3B deaminase, an APOBEC3C deaminase, and APOBEC3D deaminase, an APOBEC3E deaminase, an APOBEC3F deaminase an APOBEC3G deaminase, an APOBEC3H deaminase, or an APOBEC4 deaminase.

In the methods and systems of the present invention, the cytidine deaminase is capable of targeting Cytosine in a DNA single strand. In certain example embodiments, the cytidine deaminase may edit on a single strand present outside of the binding component, e.g., bound Cas13. In other example embodiments, the cytidine deaminase may edit at a localized bubble, such as a localized bubble formed by a mismatch at the target edit site by the guide sequence. In certain example embodiments, the cytidine deaminase may contain mutations that help focus activity such as those disclosed in Kim et al., Nature Biotechnology (2017) 35(4): 371-377 (doi:10.1038/nbt.3803.

In some embodiments, the cytidine deaminase is derived from one or more metazoa species, including but not limited to, mammals, birds, frogs, squids, fish, flies, and worms. In some embodiments, the cytidine deaminase is a human, primate, cow, dog, rat, or mouse cytidine deaminase.

In some embodiments, the cytidine deaminase is a human APOBEC, including hAPOBEC1 or hAPOBEC3. In some embodiments, the cytidine deaminase is a human AID.

In some embodiments, the cytidine deaminase protein recognizes and converts one or more target cytosine residue(s) in a single-stranded bubble of an RNA duplex into uracil residues (s). In some embodiments, the cytidine deaminase protein recognizes a binding window on the single-stranded bubble of an RNA duplex. In some embodiments, the binding window contains at least one target cytosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the cytidine deaminase protein comprises one or more deaminase domains. Not intended to be bound by theory, it is contemplated that the deaminase domain functions to recognize and convert one or more target cytosine (C) residue(s) contained in a single-stranded bubble of an RNA duplex into (a) uracil (U) residue (s). In some embodiments, the deaminase domain comprises an active center. In some embodiments, the active center comprises a zinc ion. In some embodiments, amino acid residues in or near the active center interact with one or more nucleotide(s) 5' to a target cytosine residue. In some embodiments, amino acid residues in or near the active center interact with one or more nucleotide(s) 3' to a target cytosine residue.

In some embodiments, the cytidine deaminase comprises human APOBEC1 full protein (hAPOBEC1) or the deaminase domain thereof (hAPOBEC1-D) or a C-terminally truncated version thereof (hAPOBEC-T). In some embodiments, the cytidine deaminase is an APOBEC family member that is homologous to hAPOBEC1, hAPOBEC-D or hAPOBEC-T. In some embodiments, the cytidine deaminase comprises human AID1 full protein (hAID) or the deaminase domain thereof (hAID-D) or a C-terminally truncated version thereof (hAID-T). In some embodiments, the cytidine deaminase is an AID family member that is homologous to hAID, hAID-D or hAID-T. In some embodiments, the hAID-T is a hAID which is C-terminally truncated by about 20 amino acids.

In some embodiments, the cytidine deaminase comprises the wild-type amino acid sequence of a cytosine deaminase. In some embodiments, the cytidine deaminase comprises one or more mutations in the cytosine deaminase sequence, such that the editing efficiency, and/or substrate editing preference of the cytosine deaminase is changed according to specific needs.

Certain mutations of APOBEC1 and APOBEC3 proteins have been described in Kim et al., Nature Biotechnology (2017) 35(4):371-377 (doi:10.1038/nbt.3803); and Harris et al. Mol. Cell (2002) 10:1247-1253, each of which is incorporated herein by reference in its entirety.

In some embodiments, the cytidine deaminase is an APOBEC1 deaminase comprising one or more mutations at amino acid positions corresponding to W90, R118, H121, H122, R126, or R132 in rat APOBEC1, or an APOBEC3G deaminase comprising one or more mutations at amino acid positions corresponding to W285, R313, D316, D317X, R320, or R326 in human APOBEC3G.

In some embodiments, the cytidine deaminase comprises a mutation at tryptophane90 of the rat APOBEC1 amino acid sequence, or a corresponding position in a homologous APOBEC protein, such as tryptophane285 of APOBEC3G. In some embodiments, the tryptophan residue at position 90 is replaced by a tyrosine or phenylalanine residue (W90Y or W90F).

In some embodiments, the cytidine deaminase comprises a mutation at Arginine118 of the rat APOBEC1 amino acid sequence, or a corresponding position in a homologous APOBEC protein. In some embodiments, the arginine residue at position 118 is replaced by an alanine residue (R118A).

In some embodiments, the cytidine deaminase comprises a mutation at Histidine121 of the rat APOBEC1 amino acid sequence, or a corresponding position in a homologous APOBEC protein. In some embodiments, the histidine residue at position 121 is replaced by an arginine residue (H121R).

In some embodiments, the cytidine deaminase comprises a mutation at Histidine122 of the rat APOBEC1 amino acid sequence, or a corresponding position in a homologous APOBEC protein. In some embodiments, the histidine residue at position 122 is replaced by an arginine residue (H122R).

In some embodiments, the cytidine deaminase comprises a mutation at Arginine126 of the rat APOBEC1 amino acid sequence, or a corresponding position in a homologous APOBEC protein, such as Arginine320 of APOBEC3G. In some embodiments, the arginine residue at position 126 is replaced by an alanine residue (R126A) or by a glutamic acid (R126E).

In some embodiments, the cytidine deaminase comprises a mutation at arginine132 of the APOBEC1 amino acid sequence, or a corresponding position in a homologous APOBEC protein. In some embodiments, the arginine residue at position 132 is replaced by a glutamic acid residue (R132E).

In some embodiments, to narrow the width of the editing window, the cytidine deaminase may comprise one or more of the mutations: W90Y, W90F, R126E and R132E, based on amino acid sequence positions of rat APOBEC1, and mutations in a homologous APOBEC protein corresponding to the above.

In some embodiments, to reduce editing efficiency, the cytidine deaminase may comprise one or more of the mutations: W90A, R118A, R132E, based on amino acid sequence positions of rat APOBEC1, and mutations in a homologous APOBEC protein corresponding to the above. In particular embodiments, it can be of interest to use a cytidine deaminase enzyme with reduced efficacy to reduce off-target effects.

In some embodiments, the cytidine deaminase is wild-type rat APOBEC1 (rAPOBEC1, or a catalytic domain thereof. In some embodiments, the cytidine deaminase comprises one or more mutations in the rAPOBEC1 sequence, such that the editing efficiency, and/or substrate editing preference of rAPOBEC1 is changed according to specific needs.

```
rAPOBEC1:
                                        (SEQ ID NO: 433)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLK
```

In some embodiments, the cytidine deaminase is wild-type human APOBEC1 (hAPOBEC1) or a catalytic domain thereof. In some embodiments, the cytidine deaminase comprises one or more mutations in the hAPOBEC1 sequence, such that the editing efficiency, and/or substrate editing preference of hAPOBEC1 is changed according to specific needs.

```
APOBEC1:
                                        (SEQ ID NO: 434)
MTSEKGPSTGDPTLRRRIEPWEFDVFYDPRELRKEACLLYEIKWGMSRKI

WRSSGKNTTNHVEVNFIKKFTSERDFHPSMSCSITWFLSWSPCWECSQAI

REFLSRHPGVTLVIYVARLFWHMDQQNRQGLRDLVNSGVTIQIMRASEYY
```

-continued

HCWRNFVNYPPGDEAHWPQYPPLWMMLYALELHCIILSLPPCLKISRRWQ

NHLTFFRLHLQNCHYQTIPPHILLATGLIHPSVAWR

In some embodiments, the cytidine deaminase is wild-type human APOBEC3G (hAPOBEC3G) or a catalytic domain thereof. In some embodiments, the cytidine deaminase comprises one or more mutations in the hAPOBEC3G sequence, such that the editing efficiency, and/or substrate editing preference of hAPOBEC3G is changed according to specific needs.

hAPOBEC3G:

(SEQ ID NO: 435)
MELKYHPEMRFFHWFSKWRKLHRDQEYEVTWYISWSPCTKCTRDMATFLA

EDPKVTLTIFVARLYYFWDPDYQEALRSLCQKRDGPRATMKIMNYDEFQH

CWSKFVYSQRELFEPWNNLPKYYILLHIMLGEILRHSMDPPTFTFNFNNE

PWVRGRHETYLCYEVERMHNDTWVLLNQRRGFLCNQAPHKHGFLEGRHAE

LCFLDVIPFWKLDLDQDYRVTCFTSWSPCFSCAQEMAKFISKNKHVSLCI

FTARIYDDQGRCQEGLRTLAEAGAKISIMTYSEFKHCWDTFVDHQGCPFQ

PWDGLDEHSQDLSGRLRAILQNQEN

In some embodiments, the cytidine deaminase is wild-type *Petromyzon marinus* CDA1 (pmCDA1) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

pmCDA1:

(SEQ ID NO: 436)
MTDAEYVRIHEKLDIYTFKKQFFNNKKSVSHRCYVLFELKRRGERRACFW

GYAVNKPQSGTERGIHAEIFSIRKVEEYLRDNPGQFTINWYSSWSPCADC

AEKILEWYNQELRGNGHTLKIWACKLYYEKNARNQIGLWNLRDNGVGLNV

MVSEHYQCCRKIFIQSSHNQLNENRWLEKTLKRAEKRRSELSIMIQVKIL

HTTKSPAV

In some embodiments, the cytidine deaminase is wild-type human AID (hAID) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

hAID:

(SEQ ID NO: 437)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPYLSLRIFTARLYFCEDRKAEPEGLRRLHRAGVQIAIMTFKDYFYCWNT

FVENHERTFKAWEGLHENSVRLSRQLRRILLPLYEVDDLRDAFRTLGLLD

In some embodiments, the cytidine deaminase is truncated version of hAID (hAID-DC) or a catalytic domain thereof. In some embodiments, the cytidine deaminase comprises one or more mutations in the hAID-DC sequence, such that the editing efficiency, and/or substrate editing preference of hAID-DC is changed according to specific needs.

hAID-DC:

(SEQ ID NO: 438)
MDSLLMNRRKFLYQFKNVRWAKGRRETYLCYVVKRRDSATSFSLDFGYLR

NKNGCHVELLFLRYISDWDLDPGRCYRVTWFTSWSPCYDCARHVADFLRG

NPNLSLRIFTARLYFCEDRKAEPEGLRRLHRAGVQIAIMTFKDYFYCWNT

FVENHERTFKAWEGLHENSVRLSRQLRRILL

Additional embodiments of the cytidine deaminase are disclosed in WO WO2017/070632, titled "Nucleobase Editor and Uses Thereof," which is incorporated herein by reference in its entirety.

In some embodiments, the cytidine deaminase has an efficient deamination window that encloses the nucleotides susceptible to deamination editing. Accordingly, in some embodiments, the "editing window width" refers to the number of nucleotide positions at a given target site for which editing efficiency of the cytidine deaminase exceeds the half-maximal value for that target site. In some embodiments, the cytidine deaminase has an editing window width in the range of about 1 to about 6 nucleotides. In some embodiments, the editing window width of the cytidine deaminase is 1, 2, 3, 4, 5, or 6 nucleotides.

Not intended to be bound by theory, it is contemplated that in some embodiments, the length of the linker sequence affects the editing window width. In some embodiments, the editing window width increases (e.g., from about 3 to about 6 nucleotides) as the linker length extends (e.g., from about 3 to about 21 amino acids). In a non-limiting example, a 16-residue linker offers an efficient deamination window of about 5 nucleotides. In some embodiments, the length of the guide RNA affects the editing window width. In some embodiments, shortening the guide RNA leads to a narrowed efficient deamination window of the cytidine deaminase.

In some embodiments, mutations to the cytidine deaminase affect the editing window width. In some embodiments, the cytidine deaminase component of the CD-functionalized CRISPR system comprises one or more mutations that reduce the catalytic efficiency of the cytidine deaminase, such that the deaminase is prevented from deamination of multiple cytidines per DNA binding event. In some embodiments, tryptophan at residue 90 (W90) of APOBEC1 or a corresponding tryptophan residue in a homologous sequence is mutated. In some embodiments, the catalytically inactive Cas13 is fused to or linked to an APOBEC1 mutant that comprises a W90Y or W90F mutation. In some embodiments, tryptophan at residue 285 (W285) of APOBEC3G, or a corresponding tryptophan residue in a homologous sequence is mutated. In some embodiments, the catalytically inactive Cas13 is fused to or linked to an APOBEC3G mutant that comprises a W285Y or W285F mutation.

In some embodiments, the cytidine deaminase component of CD-functionalized CRISPR system comprises one or more mutations that reduce tolerance for non-optimal presentation of a cytidine to the deaminase active site. In some embodiments, the cytidine deaminase comprises one or more mutations that alter substrate binding activity of the deaminase active site. In some embodiments, the cytidine deaminase comprises one or more mutations that alter the conformation of DNA to be recognized and bound by the deaminase active site. In some embodiments, the cytidine deaminase comprises one or more mutations that alter the substrate accessibility to the deaminase active site. In some embodiments, arginine at residue 126 (R126) of APOBEC1 or a corresponding arginine residue in a homologous sequence is mutated. In some embodiments, the catalytically inactive Cas13 is fused to or linked to an APOBEC1 that comprises a R126A or R126E mutation. In some embodiments, tryptophan at residue 320 (R320) of APOBEC3G, or a corresponding arginine residue in a homologous sequence is mutated. In some embodiments, the catalytically inactive Cas13 is fused to or linked to an APOBEC3G mutant that comprises a R320A or R320E mutation. In some embodiments, arginine at residue 132 (R132) of APOBEC1 or a corresponding arginine residue in a homologous sequence is mutated. In some embodiments, the catalytically inactive Cas13 is fused to or linked to an APOBEC1 mutant that comprises a R132E mutation.

In some embodiments, the APOBEC1 domain of the CD-functionalized CRISPR system comprises one, two, or three mutations selected from W90Y, W90F, R126A, R126E, and R132E. In some embodiments, the APOBEC1 domain comprises double mutations of W90Y and R126E. In some embodiments, the APOBEC1 domain comprises double mutations of W90Y and R132E. In some embodiments, the APOBEC1 domain comprises double mutations of R126E and R132E. In some embodiments, the APOBEC1 domain comprises three mutations of W90Y, R126E and R132E.

In some embodiments, one or more mutations in the cytidine deaminase as disclosed herein reduce the editing window width to about 2 nucleotides. In some embodiments, one or more mutations in the cytidine deaminase as disclosed herein reduce the editing window width to about 1 nucleotide. In some embodiments, one or more mutations in the cytidine deaminase as disclosed herein reduce the editing window width while only minimally or modestly affecting the editing efficiency of the enzyme. In some embodiments, one or more mutations in the cytidine deaminase as disclosed herein reduce the editing window width without reducing the editing efficiency of the enzyme. In some embodiments, one or more mutations in the cytidine deaminase as disclosed herein enable discrimination of neighboring cytidine nucleotides, which would be otherwise edited with similar efficiency by the cytidine deaminase.

In some embodiments, the cytidine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the cytidine deaminase and the substrate is mediated by one or more additional protein factor(s), including a CRISPR/CAS protein factor. In some embodiments, the interaction between the cytidine deaminase and the substrate is further mediated by one or more nucleic acid component(s), including a guide RNA.

According to the present invention, the substrate of the cytidine deaminase is a DNA single strand bubble of an RNA duplex comprising a Cytosine of interest, made accessible to the cytidine deaminase upon binding of the guide molecule to its DNA target which then forms the CRISPR-Cas complex with the CRISPR-Cas enzyme, whereby the cytosine deaminase is fused to or is capable of binding to one or more components of the CRISPR-Cas complex, i.e., the CRISPR-Cas enzyme and/or the guide molecule. The particular features of the guide molecule and CRISPR-Cas enzyme are detailed below.

Base Editing Guide Molecule Design Considerations

In some embodiments, the guide sequence is an RNA sequence of between 10 to 50 nt in length, but more particularly of about 20-30 nt advantageously about 20 nt, 23-25 nt or 24 nt. In base editing embodiments, the guide sequence is selected so as to ensure that it hybridizes to the target sequence comprising the adenosine to be deaminated. This is described more in detail below. Selection can encompass further steps which increase efficacy and specificity of deamination.

In some embodiments, the guide sequence is about 20 nt to about 30 nt long and hybridizes to the target DNA strand to form an almost perfectly matched duplex, except for having a dA-C mismatch at the target adenosine site. Particularly, in some embodiments, the dA-C mismatch is located close to the center of the target sequence (and thus the center of the duplex upon hybridization of the guide sequence to the target sequence), thereby restricting the adenosine deaminase to a narrow editing window (e.g., about 4 bp wide). In some embodiments, the target sequence may comprise more than one target adenosine to be deaminated. In further embodiments, the target sequence may further comprise one or more dA-C mismatch 3' to the target adenosine site. In some embodiments, to avoid off-target editing at an unintended Adenine site in the target sequence, the guide sequence can be designed to comprise a non-pairing Guanine at a position corresponding to said unintended Adenine to introduce a dA-G mismatch, which is catalytically unfavorable for certain adenosine deaminases such as ADAR1 and ADAR2. See Wong et al., RNA 7:846-858 (2001), which is incorporated herein by reference in its entirety.

In some embodiments, a Cas12b guide sequence having a canonical length (e.g., about 20 nt for AacC2c1) is used to form a heteroduplex with the target DNA. In some embodiments, a Cas12b guide molecule longer than the canonical length (e.g., >20 nt for AacC2c1) is used to form a heteroduplex with the target DNA including outside of the Cas12b-guide RNA-target DNA complex. This can be of interest where deamination of more than one adenine within a given stretch of nucleotides is of interest. In alternative embodiments, it is of interest to maintain the limitation of the canonical guide sequence length. In some embodiments, the guide sequence is designed to introduce a dA-C mismatch outside of the canonical length of Cas12b guide, which may decrease steric hindrance by Cas12b and increase the frequency of contact between the adenosine deaminase and the dA-C mismatch.

In some base editing embodiments, the position of the mismatched nucleobase (e.g., cytidine) is calculated from where the PAM would be on a DNA target. In some embodiments, the mismatched nucleobase is positioned 12-21 nt from the PAM, or 13-21 nt from the PAM, or 14-21 nt from the PAM, or 14-20 nt from the PAM, or 15-20 nt from the PAM, or 16-20 nt from the PAM, or 14-19 nt from the PAM, or 15-19 nt from the PAM, or 16-19 nt from the PAM, or 17-19 nt from the PAM, or about 20 nt from the PAM, or about 19 nt from the PAM, or about 18 nt from the PAM, or about 17 nt from the PAM, or about 16 nt from the PAM, or about 15 nt from the PAM, or about 14 nt from the PAM. In a preferred embodiment, the mismatched nucleobase is positioned 17-19 nt or 18 nt from the PAM.

Mismatch distance is the number of bases between the 3' end of the Cas12b spacer and the mismatched nucleobase (e.g., cytidine), wherein the mismatched base is included as part of the mismatch distance calculation. In some embodiments, the mismatch distance is 1-10 nt, or 1-9 nt, or 1-8 nt, or 2-8 nt, or 2-7 nt, or 2-6 nt, or 3-8 nt, or 3-7 nt, or 3-6 nt, or 3-5 nt, or about 2 nt, or about 3 nt, or about 4 nt, or about 5 nt, or about 6 nt, or about 7 nt, or about 8 nt. In a preferred embodiment, the mismatch distance is 3-5 nt or 4 nt.

In some embodiments, the editing window of a Cas12b-ADAR system described herein is 12-21 nt from the PAM, or 13-21 nt from the PAM, or 14-21 nt from the PAM, or 14-20 nt from the PAM, or 15-20 nt from the PAM, or 16-20 nt from the PAM, or 14-19 nt from the PAM, or 15-19 nt from the PAM, or 16-19 nt from the PAM, or 17-19 nt from the PAM, or about 20 nt from the PAM, or about 19 nt from the PAM, or about 18 nt from the PAM, or about 17 nt from the PAM, or about 16 nt from the PAM, or about 15 nt from the PAM, or about 14 nt from the PAM. In some embodiments, the editing window of the Cas12b-ADAR system described herein is 1-10 nt from the 3' end of the Cas12b spacer, or 1-9 nt from the 3' end of the Cas12b spacer, or 1-8 nt from the 3' end of the Cas12b spacer, or 2-8 nt from the 3' end of the C2c1 spacer, or 2-7 nt from the 3' end of the Cas12b spacer, or 2-6 nt from the 3' end of the Cas12b spacer, or 3-8 nt from the 3' end of the Cas12b spacer, or 3-7 nt from the 3' end of the Cas12b spacer, or 3-6 nt from the 3' end of the Cas12b spacer, or 3-5 nt from the 3' end of the Cas12b spacer, or about 2 nt from the 3' end of the Cas12b spacer, or about 3 nt from the 3' end of the Cas12b spacer, or about 4 nt from the 3' end of the Cas12b spacer, or about 5 nt from the 3' end of the Cas12b spacer, or about 6 nt from the 3' end of the Cas12b spacer, or about 7 nt from the 3' end of the Cas12b spacer, or about 8 nt from the 3' end of the Cas12b spacer.

Vectors

In general, and throughout this specification, the term "vector" refers to a nucleic acid molecule capable of transporting another nucleic acid to which it has been linked. It is a replicon, such as a plasmid, phage, or cosmid, into which another DNA segment may be inserted so as to bring about the replication of the inserted segment. Generally, a vector is capable of replication when associated with the proper control elements.

In some embodiments, the present disclosure provides for a vector system comprising one or more polynucleotides encoding one or more components of a CRISPR-Cas system. In some embodiments, the vector system is a Cas12b vector system, which comprises one or more vectors comprising: a first regulatory element operably linked to a nucleotide sequence encoding a Cas12b effector protein from Table 1 or 2, and i) a) a second regulatory element operably linked to a nucleotide sequence encoding the crRNA, and b) a third regulatory element operably linked to a nucleotide sequence encoding the tracr RNA, or ii) a second regulatory element operably linked to a nucleotide sequence encoding the crRNA and the tracr RNA. In some cases, the vector system comprises a single vector. Alternatively, the vector system comprises multiple vectors. The vector(s) may be viral vector(s).

Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells.

With regards to recombination and cloning methods, mention is made of U.S. patent application Ser. No. 10/815,730, published Sep. 2, 2004 as US 2004-0171156 A1, the contents of which are herein incorporated by reference in their entirety.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cells and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the 3-actin promoter, the phosphoglycerol kinase (PGK) promoter, and the EF1α promoter. Also encompassed by the term "regulatory element"

are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Advantageous vectors include lentiviruses and adeno-associated viruses, and types of such vectors can also be selected for targeting particular types of cells.

In particular embodiments, use is made of bicistronic vectors for guide RNA and (optionally modified or mutated) CRISPR enzymes (e.g., C2c1). Bicistronic expression vectors for guide RNA and (optionally modified or mutated) CRISPR enzymes are preferred. In general, and particularly in this embodiment (optionally modified or mutated), CRISPR enzymes are preferably driven by the CBh promoter. The RNA may preferably be driven by a Pol III promoter, such as a U6 promoter. Ideally the two are combined.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif (1990) 60-89). In some embodiments, a vector is a yeast expression vector. Examples of vectors for expression in yeast *Saccharomyces cerivisae* include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element is operably linked to one or more elements of a CRISPR system so as to drive expression of the one or more elements of the CRISPR system.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA and/or tracr could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteins or has cells containing nucleic acid-targeting effector proteins, such as by way of prior administration thereto of a vector or vectors that code for and express in vivo nucleic acid-targeting effector proteins. Alternatively, two or more of the elements expressed from the same or different regulatory elements, may be combined in a single vector, with one or more additional vectors providing any components of the nucleic acid-targeting system not included in the first vector. Nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations, and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle complex. Nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome modification.

In some embodiments, a vector encodes a C2c1 effector protein comprising one or more nuclear localization sequences (NLSs), such as about or more than about 1, 2, 3, 4, 5, 6, 7, 8, 9, 10, or more NLSs. More particularly, the vector comprises one or more NLSs not naturally present in the C2c1 effector protein. Most particularly, the NLS is present in the vector 5' and/or 3' of the C2c1 effector protein sequence. In some embodiments, the RNA-targeting effector protein comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at least one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 462); the NLS from nucleoplasmin (e.g., the nucleoplasmin bipartite NLS with the sequence KRPAATKKAGQAKKKK (SEQ ID NO: 463)); the c-myc NLS having the amino acid sequence PAAKRVKLD (SEQ ID NO: 464) or RQRRNELKRSP (SEQ ID NO: 465); the hRNPA1 M9 NLS having the sequence NQSSNFGPMKGGNFGGRSSGPYGGGGQYFAKPRNQGGY (SEQ ID NO: 466); the sequence RMRIZFKNKGKDTAELRRRRVEVSVELRKAKKDEQILKRRNV (SEQ ID NO: 467) of the IBB domain from importin-alpha; the sequences VSRKRPRP (SEQ ID NO: 468) and PPKKARED (SEQ ID NO:469) of the myoma T protein; the sequence PQPKKKPL (SEQ ID NO: 470) of human p53; the sequence SALIKKKKKMAP (SEQ ID NO: 471) of mouse c-abl IV; the sequences DRLRR (SEQ ID NO: 472) and PKQKKRK (SEQ ID NO: 473) of the influenza virus NS1; the sequence RKLKKKIKKL (SEQ ID NO: 474) of the Hepatitis virus delta antigen; the sequence REKKKFLKRR (SEQ ID NO: 475) of the mouse Mx1 protein; the sequence KRKGDEVDGVDEVAKKKSKK (SEQ ID NO: 476) of the human poly(ADP-ribose) polymerase; and the sequence RKCLQAGMNLEARKTKK (SEQ ID NO: 477) of the steroid hormone receptors (human) glucocorticoid. In general, the one or more NLSs are of sufficient strength to drive accumulation of the DNA/RNA-targeting Cas protein in a detectable amount in the nucleus of a eukaryotic cell. In general, strength of nuclear localization activity may derive from the number of NLSs in the nucleic acid-targeting effector protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for DNA or RNA cleavage or mutation at the target sequence, or assay for altered gene expression activity affected by DNA or RNA-targeting complex formation and/or DNA or RNA-targeting Cas protein activity), as compared to a control not exposed to the nucleic acid-targeting Cas protein or nucleic acid-targeting complex, or exposed to a nucleic acid-targeting Cas protein lacking the one or more NLSs. In preferred embodiments of the herein described C2c1 effector protein complexes and systems, the codon optimized C2c1 effector proteins comprise an NLS attached to the C-terminal of the protein. In certain embodiments, other localization tags may be fused to the Cas protein, such as, without limitation, for localizing the Cas to particular sites in a cell, such as organelles, mitochondria, plastids, chloroplast, vesicles, golgi, (nuclear or cellular) membranes, ribosomes, nucleoluse, ER, cytoskeleton, vacuoles, centrosome, nucleosome, granules, centrioles, etc.

The invention also provides a non-naturally occurring or engineered composition, or one or more polynucleotides encoding components of said composition, or vector systems comprising one or more polynucleotides encoding components of said composition for use in a therapeutic method of treatment. The therapeutic method of treatment may comprise gene or genome editing, or gene therapy.

In some embodiments, the therapeutic method of treatment comprises CRISPR-Cas system comprising guide sequences designed based on therapy or therapeutic in a population of a target organism. In some embodiments, the target organism population comprises at least 1000 individuals, such as at least 5000 individuals, such as at least 10000 individuals, such as at least 50000 individuals. In some embodiments, the target sites having minimal sequence variation across a population are characterized by absence of sequence variation in at least 99%, preferably at least 99.9%, more preferably at least 99.99% of the population.

As used herein, the term haplotype (haploid genotype) is a group of genes in an organism that are inherited together from a single parent. As used herein, haplotype frequency estimation (also known as "phasing") refers to the process of statistical estimation of haplotypes from genotype data. Toshikazu et al. (Am J Hum Genet. 2003 February; 72(2): 384-398) describes methods for estimation of haplotype frequencies, which may be used in the invention herein disclosed.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing, trafficking of target nucleic acids, tracing of target nucleic acids, isolation of target nucleic acids, visualization of target nucleic acids, etc.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

In certain embodiments, a vector system includes promoter-guide expression cassette in reverse order.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed.

Advantageous vectors include lentiviruses and adeno-associated viruses, and types of such vectors can also be selected for targeting particular types of cells.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector module and a nucleic acid-targeting guide RNA could each be operably linked to separate regulatory elements on separate vectors. RNA(s) of the nucleic acid-targeting system can be delivered to a transgenic nucleic acid-targeting effector module animal or mammal, e.g., an animal or mammal that constitutively or inducibly or conditionally expresses nucleic acid-targeting effector modules; or an animal or mammal that is otherwise expressing nucleic acid-targeting effector modules or has cells containing nucleic acid-targeting effector modules, such as by way of prior administration thereto of a vector or vectors that code for and express in vivo nucleic acid-targeting effector modules. Alternatively, two or more of the elements expressed from the same or different regulatory elements, may be combined in a single vector, with one or more additional vectors providing any components of the nucleic acid-targeting system not included in the first vector. Nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector module and the nucleic acid-targeting guide RNA, embedded within one or more intron sequences (e.g., each in a different intron, two or more in at least one intron, or all in a single intron). In some embodiments, the nucleic acid-targeting effector module and the nucleic acid-targeting guide RNA may be operably linked to and expressed from the same promoter.

The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, #Cb5, #Cb8r, #Cb12r, #Cb23r, 7s and PRR1. In a preferred embodiment, the bacteriophage coat protein is MS2. The invention also provides for the nucleic acid component of the complex being 30 or more, 40 or more or 50 or more nucleotides in length.

In an aspect, the invention provides a vector system comprising one or more vectors, wherein the one or more vectors comprises: a) a first regulatory element operably linked to a nucleotide sequence encoding the engineered CRISPR protein as defined herein; and optionally b) a second regulatory element operably linked to one or more nucleotide sequences encoding one or more nucleic acid molecules comprising a guide RNA comprising a guide sequence, a direct repeat sequence, optionally wherein components (a) and (b) are located on the same or different vectors.

The invention also provides an engineered, non-naturally occurring Clustered Regularly Interspersed Short Palindromic Repeats (CRISPR)-CRISPR associated (Cas effector module) (CRISPR-Cas effector module) vector system comprising one or more vectors comprising: a) a first regulatory element operably linked to a nucleotide sequence encoding a non-naturally occurring CRISPR enzyme of any one of the inventive constructs herein; and b) a second regulatory element operably linked to one or more nucleotide sequences encoding one or more of the guide RNAs, the guide RNA comprising a guide sequence, a direct repeat sequence, wherein: components (a) and (b) are located on the same or different vectors, the CRISPR complex is formed; the guide RNA targets the target polynucleotide loci and the enzyme alters the polynucleotide loci, and the enzyme in the CRISPR complex has reduced capability of modifying one or more off-target loci as compared to an unmodified enzyme and/or whereby the enzyme in the CRISPR complex has increased capability of modifying the one or more target loci as compared to an unmodified enzyme.

As used herein, a CRISPR Cas effector module or CRISRP effector module includes, but is not limited to, C2c1. In some embodiments, the CRISPR-Cas effector module may be engineered.

In such a system, component (II) may comprise a first regulatory element operably linked to a polynucleotide sequence which comprises the guide sequence, the direct repeat sequence, and wherein component (II) may comprise a second regulatory element operably linked to a polynucleotide sequence encoding the CRISPR enzyme. In such a system, where applicable the guide RNA may comprise a chimeric RNA.

In such a system, component (I) may comprise a first regulatory element operably linked to the guide sequence and the direct repeat sequence, and wherein component (II) may comprise a second regulatory element operably linked to a polynucleotide sequence encoding the CRISPR enzyme. Such a system may comprise more than one guide RNA, and each guide RNA has a different target whereby there is multiplexing. Components (a) and (b) may be on the same vector.

In any such systems comprising vectors, the one or more vectors may comprise one or more viral vectors, such as one or more retrovirus, lentivirus, adenovirus, adeno-associated virus or herpes simplex virus.

In any such systems comprising regulatory elements, at least one of said regulatory elements may comprise a tissue-specific promoter. The tissue-specific promoter may direct expression in a mammalian blood cell, in a mammalian liver cell or in a mammalian eye.

In any of the above-described compositions or systems, the direct repeat sequence may comprise one or more protein-interacting RNA aptamers. The one or more aptamers may be located in the tetraloop. The one or more aptamers may be capable of binding MS2 bacteriophage coat protein.

In any of the above-described compositions or systems, the cell may be a eukaryotic cell or a prokaryotic cell; wherein the CRISPR complex is operable in the cell, and whereby the enzyme of the CRISPR complex has reduced capability of modifying one or more off-target loci of the cell as compared to an unmodified enzyme and/or whereby the enzyme in the CRISPR complex has increased capability of modifying the one or more target loci as compared to an unmodified enzyme.

The invention also provides a CRISPR complex of any of the above-described compositions or from any of the above-described systems.

The invention also provides a method of modifying a locus of interest in a cell comprising contacting the cell with any of the herein-described engineered CRISPR enzymes (e.g., engineered Cas effector module), compositions or any of the herein-described systems or vector systems, or wherein the cell comprises any of the herein-described CRISPR complexes present within the cell. In such methods, the cell may be a prokaryotic or eukaryotic cell, preferably a eukaryotic cell. In such methods, an organism may comprise the cell. In such methods, the organism may not be a human or other animal.

In certain embodiments, the invention also provides a non-naturally occurring, engineered composition (e.g., C2c1 or any Cas protein which can fit into an AAV vector). Reference is made to FIGS. 19A, 19B, 19C, 19D, and 20A-F in U.S. Pat. No. 8,697,359 herein incorporated by reference to provide a list and guidance for other proteins which may also be used.

Any such method may be ex vivo or in vitro.

In certain embodiments, a nucleotide sequence encoding at least one of said guide RNA or C2c1 effector module is operably connected in the cell with a regulatory element comprising a promoter of a gene of interest, whereby expression of at least one CRISPR-Cas effector module system component is driven by the promoter of the gene of interest. "Operably connected" is intended to mean that the nucleotide sequence encoding the guide RNA and/or the Cas effector module is linked to the regulatory element(s) in a manner that allows for expression of the nucleotide sequence, as also referred to herein elsewhere. The term "regulatory element" is also described herein elsewhere. According to the invention, the regulatory element comprises a promoter of a gene of interest, such as preferably a promoter of an endogenous gene of interest. In certain embodiments, the promoter is at its endogenous genomic location. In such embodiments, the nucleic acid encoding the CRISPR and/or Cas effector module is under transcriptional control of the promoter of the gene of interest at its native genomic location. In certain other embodiments, the promoter is provided on a (separate) nucleic acid molecule, such as a vector or plasmid, or other extrachromosomal nucleic acid, i.e., the promoter is not provided at its native genomic location. In certain embodiments, the promoter is genomically integrated at a non-native genomic location.

The invention also provides a method of altering the expression of a genomic locus of interest in a mammalian cell comprising contacting the cell with the engineered CRISPR enzymes (e.g. engineered Cas effector module), compositions, systems or CRISPR complexes described herein and thereby delivering the CRISPR-Cas effector module (vector) and allowing the CRISPR-Cas effector module complex to form and bind to target, and determining if the expression of the genomic locus has been altered, such as increased or decreased expression, or modification of a gene product.

The invention further provides for a method of making mutations to a Cas effector module or a mutated or modified Cas effector module that is an ortholog of the CRISPR enzymes according to the invention as described herein, comprising ascertaining amino acid(s) in that ortholog may be in close proximity or may touch a nucleic acid molecule, e.g., DNA, RNA, gRNA, etc., and/or amino acid(s) analogous or corresponding to herein-identified amino acid(s) in CRISPR enzymes according to the invention as described herein for modification and/or mutation, and synthesizing or preparing or expressing the orthologue comprising, consisting of or consisting essentially of modification(s) and/or mutation(s) or mutating as herein-discussed, e.g., modifying, e.g., changing or mutating, a neutral amino acid to a charged, e.g., positively charged, amino acid, e.g., Alanine. The so modified ortholog can be used in CRISPR-Cas effector module systems; and nucleic acid molecule(s) expressing it may be used in vector systems that deliver molecules or encoding CRISPR-Cas effector module system components as herein-discussed.

In one aspect, the invention provides a kit comprising one or more of the components described herein. In some embodiments, the kit comprises a vector system and instructions for using the kit. In some embodiments, the vector system comprises (a) a first regulatory element operably linked to a direct repeat sequence and one or more insertion sites for inserting one or more guide sequences downstream of the DR sequence, wherein when expressed, the guide sequence directs sequence-specific binding of a CRISPR-Cas effector module complex to a target sequence in a eukaryotic cell, wherein the CRISPR-Cas effector module complex comprises a Cas effector module complexed with (1) the guide sequence that is hybridized to the target sequence, (2) the DR sequence, and (3) the tracr sequence; and/or (b) a second regulatory element operably linked to an enzyme-coding sequence encoding said Cas effector module comprising a nuclear localization sequence and advantageously this includes a split Cas effector module. In some embodiments, the kit comprises components (a) and (b) located on the same or different vectors of the system. In some embodiments, component (a) further comprises two or more guide sequences operably linked to the first regulatory element, wherein when expressed, each of the two or more guide sequences direct sequence specific binding of a CRISPR-Cas effector module complex to a different target sequence in a eukaryotic cell. The tracr may or may not be fused to or (encoded) on the same polynucleotide as the guide (spacer) and direct repeat sequences.

In one aspect, the invention provides a method of modifying a target polynucleotide in a eukaryotic cell. In some embodiments, the method comprises allowing a CRISPR-Cas effector module complex to bind to the target polynucleotide to effect cleavage of said target polynucleotide thereby modifying the target polynucleotide, wherein the CRISPR-Cas effector module complex comprises a Cas effector module complexed with a guide sequence hybridized to a target sequence within said target polynucleotide, wherein said guide sequence is linked to a direct repeat sequence. In some embodiments, said cleavage comprises cleaving one or two strands at the location of the target sequence by said Cas effector module; this includes a split Cas effector module. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the Cas effector module, and the guide sequence linked to the DR sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject. In one aspect, the invention provides a method of modifying or editing a target polynucleotide in a eukaryotic cell. In some embodiments, the method comprises allowing a CRISPR-Cas effector module complex to bind to the target polynucleotide to effect DNA base editing, wherein the CRISPR-Cas effector module complex comprises a Cas effector module complexed with a guide sequence hybridized to a target sequence within said target polynucleotide, wherein said guide sequence is linked to a direct repeat sequence. In some embodiments, the Cas effector module comprises a catalytically inactive CRISPR-Cas protein. In some embodiments, the guide sequence is designed to introduce one or more mismatches to the DNA/RNA heteroduplex formed between the target sequence and the guide sequence. In particular embodiments, the mismatch is an A-C mismatch. In some embodiments, the Cas effector may associate with one or more functional domains (e.g., via fusion protein or suitable linkers). In some embodiments, the effector domain comprises one or more cytidine or adenosine deaminases that mediate endogenous editing of via hydrolytic deamination.

In one aspect, the invention provides a method of modifying expression of a polynucleotide in a eukaryotic cell. In some embodiments, the method comprises allowing a CRISPR-Cas effector module complex to bind to the polynucleotide such that said binding results in increased or decreased expression of said polynucleotide; wherein the CRISPR-Cas effector module complex comprises a Cas effector module complexed with a guide sequence hybridized to a target sequence within said polynucleotide, wherein said guide sequence is linked to a direct repeat sequence; which may include a split Cas effector module. In some embodiments, the method further comprises delivering one or more vectors to said eukaryotic cells, wherein the one or more vectors drive expression of one or more of: the Cas effector module, and the guide sequence linked to the DR sequence.

In one aspect, the invention provides a method of modifying or editing a target transcript in a eukaryotic cell. In some embodiments, the method comprises allowing a CRISPR-Cas effector module complex to bind to the target polynucleotide to effect RNA base editing, wherein the CRISPR-Cas effector module complex comprises a Cas effector module complexed with a guide sequence hybridized to a target sequence within said target polynucleotide, wherein said guide sequence is linked to a direct repeat sequence. In some embodiments, the Cas effector module comprises a catalytically inactive CRISPR-Cas protein. In some embodiments, the guide sequence is designed to introduce one or more mismatches to the RNA/RNA duplex formed between the target sequence and the guide sequence. In particular embodiments, the mismatch is an A-C mismatch. In some embodiments, the Cas effector may associate with one or more functional domains (e.g., via fusion protein or suitable linkers). In some embodiments, the effector domain comprises one or more cytidine or adenosine deaminases that mediate endogenous editing via hydrolytic deamination. In particular embodiments, the effector domain comprises the adenosine deaminase acting on RNA (ADAR) family of enzymes. In particular embodiments, the adenosine deaminase protein or catalytic domain thereof capable of deaminating adenosine or cytidine in RNA is an RNA specific adenosine deaminase and/or is a bacterial, human, cephalopod, or *Drosophila* adenosine deaminase protein or catalytic domain thereof, preferably TadA, more preferably ADAR, optionally huADAR, optionally (hu)ADAR1 or (hu)ADAR2, preferably huADAR2 or catalytic domain thereof. In some embodiments, the cytidine deaminase is a human, rat or lamprey cytidine deaminase. In some embodiments, the cytidine deaminase is an apolipoprotein B mRNA-editing complex (APOBEC) family deaminase, an activation-induced deaminase (AID), or a cytidine deaminase 1 (CDA1).

The present application relates to modifying a target DNA sequence of interest.

A further aspect of the invention relates to the method and composition as envisaged herein for use in prophylactic or therapeutic treatment, preferably wherein said target locus of interest is within a human or animal and to methods of modifying an Adenine or Cytidine in a target DNA sequence of interest, comprising delivering to said target DNA, the composition as described hereinabove. In particular embodiments, the CRISPR system and the adenosine deaminase, or catalytic domain thereof, are delivered as one or more polynucleotide molecules, as a ribonucleoprotein complex, optionally via particles, vesicles, or one or more viral vectors. In particular embodiments, the composition is for use in the treatment or prevention of a disease caused by transcripts containing a pathogenic G→A or C→T point mutation. In particular embodiments, the invention thus comprises compositions for use in therapy. This implies that the methods can be performed in vivo, ex vivo or in vitro. In particular embodiments, the methods are not methods of treatment of the animal or human body or a method for modifying the germ line genetic identity of a human cell. In particular embodiments when carrying out the method, the target DNA is not comprised within a human or animal cell. In particular embodiments when the target is a human or animal target, the method is carried out ex vivo or in vitro.

A further aspect of the invention relates to the method as envisaged herein for use in prophylactic or therapeutic treatment, preferably wherein said target of interest is within a human or animal and to methods of modifying an Adenine or Cytidine in a target DNA sequence of interest, comprising delivering to said target RNA, the composition as described hereinabove. In particular embodiments, the CRISPR system and the adenosine deaminase, or catalytic domain thereof, are delivered as one or more polynucleotide molecules, as a ribonucleoprotein complex, optionally via particles, vesicles, or one or more viral vectors. In particular embodiments, the composition is for use in the treatment or prevention of a disease caused by transcripts containing a pathogenic G→A or C→T point mutation. In particular embodiments, the invention thus comprises compositions for use in therapy. This implies that the methods can be performed in vivo, ex vivo or in vitro. In particular embodiments, the methods are not methods of treatment of the animal or human body or a method for modifying the germ line genetic identity of a human cell. In particular embodiments when carrying out the method, the target DNA is not comprised within a human or animal cell. In particular embodiments when the target is a human or animal target, the method is carried out ex vivo or in vitro.

The invention also relates to a method for treating or preventing a disease by the targeted deamination or a disease causing variant. For example, the deamination of an A, may remedy a disease caused by transcripts containing a pathogenic G→A or C→T point mutation. Examples of disease that can be treated or prevented with the present invention include cancer, Meier-Gorlin syndrome, Seckel syndrome 4, Joubert syndrome 5, Leber congenital amaurosis 10; Charcot-Marie-Tooth disease, type 2; Charcot-Marie-Tooth disease, type 2; Usher syndrome, type 2C; Spinocerebellar ataxia 28; Spinocerebellar ataxia 28; Spinocerebellar ataxia 28; Long QT syndrome 2; Sjogren-Larsson syndrome; Hereditary fructosuria; Hereditary fructosuria; Neuroblastoma; Neuroblastoma; Kallmann syndrome 1; Kallmann syndrome 1; Kallmann syndrome 1; Metachromatic leukodystrophy.

In one aspect, the invention provides a method of generating a model eukaryotic cell comprising a mutated disease gene. In some embodiments, a disease gene is any gene associated with an increase in the risk of having or developing a disease. In some embodiments, the method comprises (a) introducing one or more vectors into a eukaryotic cell, wherein the one or more vectors drive expression of one or more of. Cas effector module, and a guide sequence linked to a direct repeat sequence; and (b) allowing a CRISPR-Cas effector module complex to bind to a target polynucleotide to effect cleavage of the target polynucleotide within said disease gene, wherein the CRISPR-Cas effector module complex comprises a Cas effector module complexed with (1) the guide sequence that is hybridized to the target sequence within the target polynucleotide, (2) the DR sequence, and (3) the tracr sequence, thereby generating a model eukaryotic cell comprising a mutated disease gene; this includes a split Cas effector module. In some embodiments, said cleavage comprises cleaving one or two strands at the location of the target sequence by said Cas effector module. In a preferred embodiment, the strand break is a staggered cut with a 5' overhang. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence. In some embodiments, the model eukaryotic cell comprises a mutated disease gene, wherein the mutation is introduced by staggered double strand breaks with a 5' overhang. In particular embodiments, the 5' overhang is 7 nt. In some embodiments, the model eukaryotic cell comprises a mutated disease gene, wherein the mutation is introduced by a DNA insert at the staggered 5' overhang through HDR. In some embodiments, the model eukaryotic cell comprises a mutated disease gene, wherein the mutation is introduced by a DNA insert at the staggered 5' overhang through NHEJ. In some embodiments, the model eukaryotic cell comprises an exogenous DNA sequence insertion introduced by the CRISPR-C2c1 system. In particular embodiments, the CRISPR-C2c1 system comprises the exogenous DNA flanked by guide sequences on both 5' and 3' ends. In some embodiments, the model eukaryotic cell comprises a mutated disease gene, wherein the mutation is introduced by a DNA insert at the staggered 5' overhang. In a particular embodiment, the Cas effector module comprises a C2c1 protein, or catalytic domain thereof, and the PAM sequence is a T-rich sequence. In particular embodiments, the PAM is 5'-TTN or 5'-ATTN, wherein N is any nucleotide. In a particular embodiment, the PAM is 5'-TTG. In particular embodiments, the model eukaryotic cell comprises a mutated gene associated with cancer. In a particular embodiment, the model eukaryotic cell comprises a mutated disease gene associated with human papillomavirus (HPV) driven carcinogenesis in cervical intraepithelial neoplasia (CIN). In other particular embodiments, the model eukaryotic cell comprises a mutated disease gene associated with Parkinson's disease, cystic fibrosis, cardiomyopathy, and ischemic heart disease.

In one aspect, the invention provides for a method of selecting one or more cell(s) by introducing one or more mutations in a gene in the one or more cell (s), the method comprising: introducing one or more vectors into the cell (s), wherein the one or more vectors drive expression of one or more of: a Cas effector module, a guide sequence linked to a direct repeat sequence, and an editing template; wherein the editing template comprises the one or more mutations that abolish Cas effector module cleavage; allowing homologous recombination of the editing template with the target polynucleotide in the cell(s) to be selected; allowing a CRISPR-Cas effector module complex to bind to a target polynucleotide to effect cleavage of the target polynucleotide within said gene, wherein the CRISPR-Cas effector module complex comprises the Cas effector module complexed with (1) the guide sequence that is hybridized to the target sequence within the target polynucleotide, and (2) the direct repeat sequence, wherein binding of the Cas effector module CRISPR-Cas effector module complex to the target polynucleotide induces cell death, thereby allowing one or more cell(s) in which one or more mutations have been introduced to be selected; this includes a split Cas effector module. In another preferred embodiment of the invention, the cell to be selected may be a eukaryotic cell. Aspects of the invention allow for selection of specific cells without requiring a selection marker or a two-step process that may include a counter-selection system.

In one aspect, the invention provides a method of generating a eukaryotic cell comprising a modified or edited gene. In some embodiments, the modified or edited gene is a disease gene. In some embodiments, the method comprises (a) introducing one or more vectors into a eukaryotic cell, wherein the one or more vectors drive expression of one or more of: Cas effector module, and a guide sequence linked to a direct repeat sequence, wherein the Cas effector module associate one or more effector domains that mediate base editing, and (b) allowing a CRISPR-Cas effector module complex to bind to a target polynucleotide to effect base editing of the target polynucleotide within said disease gene, wherein the CRISPR-Cas effector module complex comprises a Cas effector module complexed with the guide sequence that is hybridized to the target sequence within the target polynucleotide, wherein the guide sequence may be designed to introduce one or more mismatches between the DNA/RNA heteroduplex or the RNA/RNA duplex formed between the guide sequence and the target sequence. In particular embodiments, the mismatch is an A-C mismatch. In some embodiments, the Cas effector may associate with one or more functional domains (e.g., via fusion protein or suitable linkers). In some embodiments, the effector domain comprises one or more cytidine or adenosine deaminases that mediate endogenous editing via hydrolytic deamination. In particular embodiments, the effector domain comprises the adenosine deaminase acting on RNA (ADAR) family of enzymes. In particular embodiments, the adenosine deaminase protein or catalytic domain thereof capable of deaminating adenosine or cytidine in RNA is an RNA specific adenosine deaminase and/or is a bacterial, human, cephalopod, or *Drosophila* adenosine deaminase protein or catalytic domain thereof, preferably TadA, more preferably ADAR, optionally huADAR, optionally (hu)ADAR1 or (hu) ADAR2, preferably huADAR2 or catalytic domain thereof. In some embodiments, the cytidine deaminase is a human, rat or lamprey cytidine deaminase. In some embodiments, the cytidine deaminase is an apolipoprotein B mRNA-editing complex (APOBEC) family deaminase, an activation-induced deaminase (AID), or a cytidine deaminase 1 (CDA1).

A further aspect relates to an isolated cell obtained or obtainable from the methods described above and/or comprising the composition described above or progeny of said modified cell, preferably wherein said cell comprises a hypoxanthine or a guanine in replace of said Adenine in said target RNA of interest compared to a corresponding cell not subjected to the method. In particular embodiments, the cell is a eukaryotic cell, preferably a human or non-human animal cell, optionally a therapeutic T cell or an antibody-producing B-cell or wherein said cell is a plant cell. A further aspect provides a non-human animal or a plant comprising said modified cell or progeny thereof. Yet a further aspect provides the modified cell as described hereinabove for use in therapy, preferably cell therapy.

In some embodiments, the modified cell is a therapeutic T cell, such as a T cell suitable for CAR-T therapies. The modification may result in one or more desirable traits in the therapeutic T cell, including but not limited to, reduced expression of an immune checkpoint receptor (e.g., PDA, CTLA4), reduced expression of HLA proteins (e.g., B2M, HLA-A), and reduced expression of an endogenous TCR.

The invention further relates to a method for cell therapy, comprising administering to a patient in need thereof the modified cell described herein, wherein the presence of the modified cell remedies a disease in the patient. In one embodiment, the modified cell for cell therapy is a CAR-T cell capable of recognizing and/or attacking a tumor cell. In another embodiment, the modified cell for cell therapy is a stem cell, such as a neural stem cell, a mesenchymal stem cell, a hematopoietic stem cell, or an iPSC cell.

Compositions comprising a Cas effector module, complex or system comprising multiple guide RNAs, preferably tandemly arranged, or the polynucleotide or vector encoding or comprising said Cas effector module, complex or system comprising multiple guide RNAs, preferably tandemly arranged, for use in the methods of treatment as defined herein elsewhere are also provided. A kit of parts may be provided including such compositions. Use of said composition in the manufacture of a medicament for such methods of treatment are also provided. Use of a Cas effector module CRISPR system in screening is also provided by the present invention, e.g., gain of function screens. Cells which are artificially forced to overexpress a gene are able to down regulate the gene over time (re-establishing equilibrium), e.g., by negative feedback loops. By the time the screen starts, the unregulated gene might be reduced again. Using an inducible Cas effector module activator allows one to induce transcription right before the screen and therefore minimizes the chance of false negative hits. Accordingly, by use of the instant invention in screening, e.g., gain of function screens, the chance of false negative results may be minimized.

In another aspect, the invention provides an engineered, non-naturally occurring vector system comprising one or more vectors comprising a first regulatory element operably linked to the multiple Cas12b CRISPR system guide RNAs that each specifically target a DNA molecule encoding a gene product and a second regulatory element operably linked coding for a CRISPR protein. Both regulatory elements may be located on the same vector or on different vectors of the system. The multiple guide RNAs target the multiple DNA molecules encoding the multiple gene products in a cell and the CRISPR protein may cleave the multiple DNA molecules encoding the gene products (it may cleave one or both strands or have substantially no nuclease activity), whereby expression of the multiple gene products is altered; and, wherein the CRISPR protein and the multiple guide RNAs do not naturally occur together. In a preferred embodiment, the CRISPR protein is Cas12b protein, optionally codon optimized for expression in a eukaryotic cell. In a preferred embodiment, the eukaryotic cell is a mammalian cell, a plant cell or a yeast cell and in a more preferred embodiment the mammalian cell is a human cell. In a further embodiment of the invention, the expression of each of the multiple gene products is altered, preferably decreased.

In one aspect, the invention provides a vector system comprising one or more vectors. In some embodiments, the system comprises: (a) a first regulatory element operably linked to a direct repeat sequence and one or more insertion sites for inserting one or more guide sequences up- or downstream (whichever applicable) of the direct repeat sequence, wherein when expressed, the one or more guide sequence(s) direct(s) sequence-specific binding of the CRISPR complex to the one or more target sequence(s) in a eukaryotic cell, wherein the CRISPR complex comprises a Cas12b enzyme complexed with the one or more guide sequence(s) that is hybridized to the one or more target sequence(s); and (b) a second regulatory element operably linked to an enzyme-coding sequence encoding said Cas12b enzyme, preferably comprising at least one nuclear localization sequence and/or at least one NES; wherein components (a) and (b) are located on the same or different vectors of the system. Where applicable, a tracr sequence may also be provided. In some embodiments, component (a) further comprises two or more guide sequences operably linked to the first regulatory element, wherein when expressed, each of the two or more guide sequences direct sequence specific binding of a Cas12b CRISPR complex to a different target sequence in a eukaryotic cell. In some embodiments, the CRISPR complex comprises one or more nuclear localization sequences and/or one or more NES of sufficient strength to drive accumulation of said Cas12b CRISPR complex in a detectable amount in or out of the nucleus of a eukaryotic cell. In some embodiments, the first regulatory element is a polymerase III promoter. In some embodiments, the second regulatory element is a polymerase II promoter. In some embodiments, each of the guide sequences is at least 16, 17, 18, 19, 20, 25 nucleotides, or between 16-30, or between 16-25, or between 16-20 nucleotides in length.

Recombinant expression vectors can comprise the polynucleotides encoding the Cas12b enzyme, system or complex for use in multiple targeting as defined herein in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

In some embodiments, a host cell is transiently or non-transiently transfected with one or more vectors comprising the polynucleotides encoding the Cas12b enzyme, system or complex for use in multiple targeting as defined herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art and exemplified herein elsewhere. Cell lines are available from a variety of sources known to those with skill in the art (see, e.g., the American Type Culture Collection (ATCC) (Manassas, Va.)). In some embodiments, a cell transfected with one or more vectors comprising the polynucleotides encoding the Cas12b enzyme, system or complex for use in multiple targeting as defined herein is used to establish a new cell line comprising one or more vector-derived sequences. In some embodiments, a cell transiently transfected with the components of a Cas12b CRISPR system or complex for use in multiple targeting as described herein (such as by transient transfection of one or more vectors, or transfection with RNA), and modified through the activity of a Cas12b CRISPR system or complex, is used to establish a new cell line comprising cells containing the modification but lacking any other exogenous sequence. In some embodiments, cells transiently or non-transiently transfected with one or more vectors comprising the polynucleotides encoding the Cas12b enzyme, system or complex for use in multiple targeting as defined herein, or cell lines derived from such cells are used in assessing one or more test compounds.

The term "regulatory element" is as defined herein elsewhere.

Advantageous vectors include lentiviruses and adeno-associated viruses, and types of such vectors can also be selected for targeting particular types of cells.

In one aspect, the invention provides a eukaryotic host cell comprising (a) a first regulatory element operably linked to a direct repeat sequence and one or more insertion sites for inserting one or more guide RNA sequences up- or downstream (whichever applicable) of the direct repeat sequence, wherein when expressed, the guide sequence(s) direct(s) sequence-specific binding of the Cas12b CRISPR complex to the respective target sequence(s) in a eukaryotic cell, wherein the Cas12b CRISPR complex comprises a Cas12b enzyme complexed with the one or more guide sequence(s) that is hybridized to the respective target sequence(s); and/or (b) a second regulatory element operably linked to an enzyme-coding sequence encoding said Cas12b enzyme comprising preferably at least one nuclear localization sequence and/or NES. In some embodiments, the host cell comprises components (a) and (b). Where applicable, a tracr sequence may also be provided. In some embodiments, component (a), component (b), or components (a) and (b) are stably integrated into a genome of the host eukaryotic cell. In some embodiments, component (a) further comprises two or more guide sequences operably linked to the first regulatory element, and optionally separated by a direct repeat, wherein when expressed, each of the two or more guide sequences direct sequence specific binding of a Cas12b CRISPR complex to a different target sequence in a eukaryotic cell. In some embodiments, the Cas12b enzyme comprises one or more nuclear localization sequences and/or nuclear export sequences or NES of sufficient strength to drive accumulation of said CRISPR enzyme in a detectable amount in and/or out of the nucleus of a eukaryotic cell.

In some embodiments, the guide molecule forms a duplex with a target DNA strand comprising at least one target adenosine residues to be edited. Upon hybridization of the guide RNA molecule to the target DNA strand, the adenosine deaminase binds to the duplex and catalyzes deamination of one or more target adenosine residues comprised within the DNA-RNA duplex.

Further, engineering of the PAM Interacting (PI) domain may allow programing of PAM specificity, improve target site recognition fidelity, and increase the versatility of the CRISPR-Cas protein, for example as described for Cas9 in Kleinstiver B P et al. Engineered CRISPR-Cas9 nucleases with altered PAM specificities. Nature. 2015 Jul. 23; 523 (7561):481-5. doi: 10.1038/nature14592. As further detailed herein, the skilled person will understand that C2c1 proteins may be modified analogously.

In particular embodiments, the guide sequence is selected in order to ensure optimal efficiency of the deaminase on the adenine to be deaminated. The position of the adenine in the target strand relative to the cleavage site of the C2c1 nickase may be taken into account. In particular embodiments, it is of interest to ensure that the nickase will act in the vicinity of the adenine to be deaminated, on the non-target strand. For instance, in particular embodiments, the Cas12b nickase cuts the non-targeting strand downstream of the PAM and it can be of interest to design the guide such that the cytosine which is to correspond to the adenine to be deaminated is located in the guide sequence within 10 bp upstream or downstream of the nickase cleavage site in the sequence of the corresponding non-target strand.

Delivery

In some embodiments, the components of the CRISPR-Cas system may be delivered in various forms, such as combinations of DNA/RNA or RNA/RNA or protein RNA. For example, the C2c1 protein may be delivered as a DNA-coding polynucleotide or an RNA-coding polynucleotide or as a protein. The guide may be delivered as a DNA-coding polynucleotide or an RNA. All possible combinations are envisioned, including mixed forms of delivery.

In some aspects, the invention provides methods comprising delivering one or more polynucleotides, such as or one or more vectors as described herein, one or more transcripts thereof, and/or one or proteins transcribed therefrom, to a host cell.

Vectors as Delivery Vehicles

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells.

With regards to recombination and cloning methods, mention is made of U.S. patent application Ser. No. 10/815, 730, published Sep. 2, 2004 as US 2004-0171156 A1, the contents of which are herein incorporated by reference in their entirety.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cells and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoters (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Advantageous vectors include lentiviruses and adeno-associated viruses, and types of such vectors can also be selected for targeting particular types of cells.

In particular embodiments, use is made of bicistronic vectors for the guide RNA and (optionally modified or mutated) the CRISPR-Cas protein fused to adenosine deaminase. Bicistronic expression vectors for guide RNA and (optionally modified or mutated) CRISPR-Cas protein fused to adenosine deaminase are preferred. In general, and particularly in this embodiment (optionally modified or mutated), CRISPR-Cas protein fused to adenosine deaminase is preferably driven by the CBh promoter. The RNA may preferably be driven by a Pol III promoter, such as a U6 promoter. Ideally the two are combined.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif (1990) 60-89). In some embodiments, a vector is a yeast expression vector. Examples of vectors for expression in yeast *Saccharomyces cerivisae* include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element is operably linked to one or more elements of a CRISPR system so as to drive expression of the one or more elements of the CRISPR system.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteins or has cells containing nucleic acid-targeting effector proteins, such as by way of prior administration thereto of a vector or vectors that code for and express in vivo nucleic acid-targeting effector proteins. Alternatively, two or more of the elements expressed from the same or different regulatory elements, may be combined in a single vector, with one or more additional vectors providing any components of the nucleic acid-targeting system not included in the first vector. Nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations, and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle complex. Nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome modification.

Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-

217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787, and 4,897,355, and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g., in vitro or ex vivo administration) or target tissues (e.g., in vivo administration).

Plasmid delivery involves the cloning of a guide RNA into a CRISPR-Cas protein expressing plasmid and transfecting the DNA in cell culture. Plasmid backbones are available commercially and no specific equipment is required. They have the advantage of being modular, capable of carrying different sizes of CRISPR-Cas coding sequences (including those encoding larger sized proteins) as well as selection markers. Another advantage of plasmids is that they can ensure transient, but sustained expression. However, delivery of plasmids is not straightforward such that in vivo efficiency is often low. The sustained expression can also be disadvantageous in that it can increase off-target editing. In addition, excess build-up of the CRISPR-Cas protein can be toxic to the cells. Finally, plasmids always hold the risk of random integration of the dsDNA in the host genome, more particularly in view of the double-stranded breaks being generated (on and off-target).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787). This is discussed more in detail below.

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

The invention provides AAV that contains or consists essentially of an exogenous nucleic acid molecule encoding a CRISPR system, e.g., a plurality of cassettes comprising or consisting of a first cassette comprising or consisting essentially of a promoter, a nucleic acid molecule encoding a CRISPR-associated (Cas) protein (putative nuclease or helicase proteins), e.g., C2c1 and a terminator, and one or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator, where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., Cas (C2c1) and a terminator, and a second rAAV containing one or more cassettes each comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator, where N is a number that can be inserted that is at an upper limit of the packaging size limit of the vector). Alternatively, because C2c1 can process its own crRNA/gRNA, a single crRNA/gRNA array can be used for multiplex gene editing. Hence, instead of including multiple cassettes to deliver the gRNAs, the rAAV may contain a single cassette comprising or consisting essentially of a promoter, a plurality of crRNA/gRNA, and a terminator (e.g., schematically represented as Promoter-gRNA1-gRNA2 . . . gRNA(N)-terminator, where N is a number that can be inserted that is at an upper limit of the packaging size limit of the vector). See Zetsche et al Nature Biotechnology 35, 31-34 (2017), which is incorporated herein by reference in its entirety. As rAAV is a DNA virus, the nucleic acid molecules in the herein discussion concerning AAV or rAAV are advantageously DNA. The promoter is in some embodiments advantageously human Synapsin I promoter (hSyn). Additional methods for the delivery of nucleic acids to cells are known to those skilled in the art. See, for example, US20030087817, incorporated herein by reference.

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral.

In some embodiments, a host cell is transiently or non-transiently transfected with one or more vectors described herein. In some embodiments, a cell is transfected as it naturally occurs in a subject optionally to be reintroduced therein. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In particular embodiments, transient expression and/or presence of one or more of the components of the AD-functionalized CRISPR system can be of interest, such as to reduce off-target effects. In some embodiments, a cell transfected with one or more vectors described herein is used to establish a new cell line comprising one or more vector-derived sequences. In some embodiments, a cell transiently transfected with the components of an AD-functionalized CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, it is envisaged to introduce the RNA and/or protein directly to the host cell. For instance, the CRISPR-Cas protein can be delivered as encoding mRNA together with an in vitro transcribed guide RNA. Such methods can reduce the time to ensure effect of the CRISPR-Cas protein and further prevents long-term expression of the CRISPR system components.

In some embodiments, the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example, Tolentino et al., Retina 24(4):660 which may also be applied to the present invention).

Indeed, RNA delivery is a useful method of in vivo delivery. It is possible to deliver CcC1, adenosine deaminase, and guide RNA into cells using liposomes or particles.

Thus, delivery of the CRISPR-Cas protein, such as a C2c1, the delivery of the adenosine deaminase (which may be fused to the CRISPR-Cas protein or an adaptor protein), and/or delivery of the RNAs of the invention may be in RNA form and via microvesicles, liposomes or particle or nanoparticles. For example, C2c1 mRNA, adenosine deaminase mRNA, and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 November 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purified and characterized from transfected cell supernatant, then RNA is loaded into the exosomes. Delivery or administration according to the invention can be performed with exosomes, in particular, but not limited to, the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 μmol of CRISPR Cas targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 μl of a recombinant lentivirus having a titer of 1×109 transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of 1×109 transducing units (TU)/ml may be contemplated.

Dosage of Vectors

In some embodiments, the vector, e.g., plasmid or viral vector, is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin, and a combination thereof. A thorough discussion of pharmaceutically acceptable excipients is available in REMINGTON'S PHARMACEUTICAL SCIENCES (Mack Pub. Co., N. J. 1991) which is incorporated by reference herein.

In an embodiment herein, the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^9$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{100}$ functional AAV/ml solution. The dosage may be adjusted to balance the therapeutic benefit against any side effects. In an embodiment herein, the AAV dose is generally in the range of concentrations of from about $1\times10^{5}$ to $1\times10^{50}$ genomes AAV, from about $1\times10^{8}$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein, the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 g to about 10 g per 70 kg individual. Plasmids of the invention will generally comprise (i) a promoter; (ii) a sequence encoding a CRISPR-Cas protein, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

The dosage used for the compositions provided herein include dosages for repeated administration or repeat dosing. In particular embodiments, the administration is repeated within a period of several weeks, months, or years. Suitable assays can be performed to obtain an optimal dosage regime. Repeated administration can allow the use of lower dosage, which can positively affect off-target modifications.

RNA Delivery

In particular embodiments, RNA based delivery is used. In these embodiments, mRNA of the CRISPR-Cas protein, mRNA of the adenosine deaminase (which may be fused to a CRISPR-Cas protein or an adaptor), are delivered together with in vitro transcribed guide RNA. Liang et al. describes efficient genome editing using RNA based delivery (Protein Cell. 2015 May; 6(5): 363-372). In some embodiments, the mRNA(s) encoding C2c1 and/or adenosine deaminase can be chemically modified, which may lead to improved activity compared to plasmid-encoded C2c1 and/or adenosine deaminase. For example, uridines in the mRNA(s) can be partially or fully substituted with pseudouridine (Ψ), N1-methylpseudouridine (me1Ψ), 5-methoxyuridine (5moU). See Li et al., Nature Biomedical Engineering 1, 0066 DOI:10.1038/s41551-017-0066 (2017), which is incorporated herein by reference in its entirety.

Exemplary of Delivery Approaches

RNP

In particular embodiments, pre-complexed guide RNA, CRISPR-Cas protein, and adenosine deaminase (which may be fused to a CRISPR-Cas protein or an adaptor) are delivered as a ribonucleoprotein (RNP). RNPs have the advantage that they lead to rapid editing effects even more so than the RNA method because this process avoids the need for transcription. An important advantage is that both RNP delivery is transient, reducing off-target effects and toxicity issues. Efficient genome editing in different cell types has been observed by Kim et al. (2014, Genome Res. 24(6):1012-9), Paix et al. (2015, Genetics 204(1):47-54), Chu et al. (2016, BMC Biotechnol. 16:4), and Wang et al. (2013, Cell. 9; 153(4):910-8).

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly, these polypeptides can be used for the delivery of CRISPR-effector based RNPs in eukaryotic cells.

Particles

In some aspects or embodiments, a composition comprising a delivery particle formulation may be used. In some aspects or embodiments, the formulation comprises a CRISPR complex, the complex comprising a CRISPR protein and a guide which directs sequence-specific binding of the CRISPR complex to a target sequence. In some embodiments, the delivery particle comprises a lipid-based particle, optionally a lipid nanoparticle, or cationic lipid and optionally biodegradable polymer. In some embodiments, the cationic lipid comprises 1,2-dioleoyl-3-trimethylammonium-propane (DOTAP). In some embodiments, the hydrophilic polymer comprises ethylene glycol or polyethylene glycol. In some embodiments, the delivery particle further comprises a lipoprotein, preferably cholesterol. In some embodiments, the delivery particles are less than 500 nm in diameter, optionally less than 250 nm in diameter, optionally less than 100 nm in diameter, optionally about 35 nm to about 60 nm in diameter.

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g., diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

In terms of this invention, it is preferred to have one or more components of CRISPR complex, e.g., CRISPR-Cas protein or mRNA, or adenosine deaminase (which may be fused to a CRISPR-Cas protein or an adaptor) or mRNA, or guide RNA delivered using nanoparticles or lipid envelopes. Other delivery systems or vectors may be used in conjunction with the particle aspects of the invention.

In general, a "nanoparticle" refers to any particle having a diameter of less than 1000 nm. In certain embodiments, nanoparticles of the invention have a greatest dimension (e.g., diameter) of 500 nm or less. In other embodiments, nanoparticles of the invention have a greatest dimension ranging between 25 nm and 200 nm. In other embodiments, nanoparticles of the invention have a greatest dimension of 100 nm or less. In other embodiments, nanoparticles of the invention have a greatest dimension ranging between 35 nm and 60 nm. It will be appreciated that reference made herein to particles or nanoparticles can be interchangeable, where appropriate.

It will be understood that the size of the particle will differ depending as to whether it is measured before or after loading. Accordingly, in particular embodiments, the term "nanoparticles" may apply only to the particles pre-loading.

Particles encompassed in the present invention may be provided in different forms, e.g., as solid particles (e.g., metal such as silver, gold, iron, titanium), non-metal, lipid-based solids, polymers, suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarization interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR-Cas protein or mRNA, adenosine deaminase (which may be fused to a CRISPR-Cas protein or an adaptor) or mRNA, or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

CRISPR-Cas protein mRNA, adenosine deaminase (which may be fused to a CRISPR-Cas protein or an adaptor) or mRNA, and guide RNA may be delivered simultaneously using particles or lipid envelopes; for instance, CRISPR-Cas protein and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (e.g., a Type V protein such as C2c1) mRNA and guide RNA may be delivered simultaneously using particles or lipid envelopes.

Examples of suitable particles include, but are not limited to, those described in U.S. Pat. No. 9,301,923.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured particles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles/nanoparticles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs, are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al., Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, particles/nanoparticles that can deliver RNA to a cancer cell to stop tumor growth developed by Dan Anderson's lab at MIT may be used/and or adapted to the AD-functionalized CRISPR-Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds that are also particularly useful in the administration of polynucleotides, which may be applied to deliver the AD-functionalized CRISPR-Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) that has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the AD-functionalized CRISPR-Cas system of the present invention.

Preassembled recombinant CRISPR-Cas complexes comprising C2c1, adenosine deaminase (which may be fused to C2c1 or an adaptor protein), and guide RNA may be transfected, for example by electroporation, resulting in high mutation rates and absence of detectable off-target mutations. Hur, J. K. et al, Targeted mutagenesis in mice by electroporation of C2c1 ribonucleoproteins, Nat Biotechnol. 2016 Jun. 6. doi: 10.1038/nbt.3596.

In terms of local delivery to the brain, this can be achieved in various ways. For instance, material can be delivered intrastriatally e.g., by injection. Injection can be performed stereotactically via a craniotomy.

In some embodiments, sugar-based particles may be used, for example GalNAc, as described herein and with reference to WO2014118272 (incorporated herein by reference) and Nair, J K et al., 2014, Journal of the American Chemical Society 136 (49), 16958-16961) and the teaching herein, especially in respect of delivery applies to all particles unless otherwise apparent. This may be considered to be a sugar-based particle and further details on other particle delivery systems and/or formulations are provided herein. GalNAc can therefore be considered to be a particle in the sense of the other particles described herein, such that general uses and other considerations, for instance delivery of said particles, apply to GalNAc particles as well. A solution-phase conjugation strategy may for example be used to attach triantennary GalNAc clusters (mol. wt. ~2000) activated as PFP (pentafluorophenyl) esters onto 5'-hexylamino modified oligonucleotides (5'-HA ASOs, mol. wt. ~8000 Da; Ostergaard et al., Bioconjugate Chem., 2015, 26 (8), pp 1451-1455). Similarly, poly(acrylate) polymers have been described for in vivo nucleic acid delivery (see WO2013158141 incorporated herein by reference). In further alternative embodiments, pre-mixing CRISPR nanoparticles (or protein complexes) with naturally occurring serum proteins may be used in order to improve delivery (Akinc A et al, 2010, Molecular Therapy vol. 18 no. 7, 1357-1364).

Nanoclews

Further, the AD-functionalized CRISPR system may be delivered using nanoclews, for example as described in Sun W et al, *Cocoon-like self-degradable DNA nanoclew for anticancer drug delivery*., J Am Chem Soc. 2014 Oct. 22; 136(42):14722-5. doi: 10.1021/ja5088024. Epub 2014 Oct. 13.; or in Sun W et al, *Self-Assembled DNA Nanoclews for the Efficient Delivery of CRISPR-Cas9 for Genome Editing*., Angew Chem Int Ed Engl. 2015 Oct. 5; 54(41):12029-33. doi: 10.1002/anie.201506030. Epub 2015 Aug. 27.

Livid Particles

In some embodiments, delivery is by encapsulation of the C2c1 protein or mRNA form in a lipid particle such as an LNP. In some embodiments, therefore, lipid particles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetaminophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration, as cationic lipids are combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 g/ml of LNP or CRISPR-Cas RNA in or associated with the LNP may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, December 2011. The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC: CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a CRISPR-Cas system or components thereof.

A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes maintain the desired particle size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-μm syringe filter.

Spherical Nucleic Acid (SNA™) constructs and other particles (particularly gold nanoparticles) are also contemplated as a means to delivery CRISPR-Cas system to intended targets. Significant data show that AuraSense Therapeutics' Spherical Nucleic Acid (SNA™) constructs, based upon nucleic acid-functionalized gold nanoparticles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts an RNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumors, Davis et al. investigated biopsies from three patients from three different dosing cohorts; patients A, B and C, all of whom had metastatic melanoma and received CALAA-01 doses of 18, 24 and 30 mg $m^{-2}$ siRNA, respectively. Similar doses may also be contemplated for the CRISPR Cas system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid. U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material. U.S. Pat. No. 5,855,913, incorporated herein by reference, provides a particulate composition having aerodynamically light particles having a tap density of less than 0.4 g/cm3 with a mean diameter of between 5 μm and 30 p m, incorporating a surfactant on the surface thereof for drug delivery to the pulmonary system. U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system. U.S. Pat. No. 5,543,158, incorporated herein by reference, provides biodegradable injectable particles having a biodegradable solid core containing a biologically active material and poly(alkylene glycol) moieties on the surface. WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such conjugated lipomers can be used in the context of the CRISPR-Cas system to achieve in vitro, ex vivo and in vivo genomic perturbations to modify gene expression, including modulation of protein expression.

In one embodiment, the particle may be epoxide-modified lipid-polymer, advantageously 7C1 (see, e.g., James E. Dahlman and Carmen Barnes et al. Nature Nanotechnology (2014) published online 11 May 2014, doi:10.1038/nnano.2014.84). C71 was synthesized by reacting C15 epoxide-terminated lipids with PEI600 at a 14:1 molar ratio, and was formulated with C14PEG2000 to produce particles (diameter between 35 and 60 nm) that were stable in PBS solution for at least 40 days.

An epoxide-modified lipid-polymer may be utilized to deliver the CRISPR-Cas system of the present invention to pulmonary, cardiovascular, or renal cells, however, one of skill in the art may adapt the system to deliver to other target organs. Dosages ranging from about 0.05 to about 0.6 mg/kg are envisioned. Dosages over several days or weeks are also envisioned, with a total dosage of about 2 mg/kg.

In some embodiments, the LNP for delivering the RNA molecules is prepared by methods known in the art, such as those described in, for example, WO 2005/105152 (PCT/EP2005/004920), WO 2006/069782 (PCT/EP2005/014074), WO 2007/121947 (PCT/EP2007/003496), and WO 2015/082080 (PCT/EP2014/003274), which are herein incorporated by reference. LNPs aimed specifically at the enhanced and improved delivery of siRNA into mammalian cells are described in, for example, Aleku et al., *Cancer Res.,* 68(23): 9788-98 (Dec. 1, 2008), Strumberg et al., *Int. J. Clin. Pharmacol. Ther.,* 50(1): 76-8 (January 2012), Schultheis et al., *J. Clin. Oncol.,* 32(36): 4141-48 (Dec. 20, 2014), and Fehring et al., *Mol. Ther.,* 22(4): 811-20 (Apr. 22, 2014), which are herein incorporated by reference and may be applied to the present technology.

In some embodiments, the LNP includes any LNP disclosed in WO 2005/105152 (PCT/EP2005/004920), WO 2006/069782 (PCT/EP2005/014074), WO 2007/121947 (PCT/EP2007/003496), and WO 2015/082080 (PCT/EP2014/003274).

In some embodiments, the LNP includes at least one lipid having Formula I:

(Formula I)

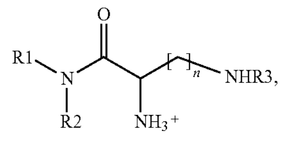

wherein R1 and R2 are each and independently selected from the group comprising alkyl, n is any integer between 1 and 4, and R3 is an acyl selected from the group comprising lysyl, ornithyl, 2,4-diaminobutyryl, histidyl and an acyl moiety according to Formula II:

(Formula II)

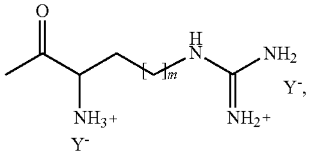

wherein m is any integer from 1 to 3 and Y− is a pharmaceutically acceptable anion. In some embodiments, a lipid according to Formula I includes at least two asymmetric C atoms. In some embodiments, enantiomers of Formula I include, but are not limited to, R—R; S—S; R—S and S—R enantiomer.

In some embodiments, R1 is lauryl and R2 is myristyl. In another embodiment, R1 is palmityl and R2 is oleyl. In some embodiments, m is 1 or 2. In some embodiments, Y− is selected from halogenids, acetate or trifluoroacetate.

In some embodiments, the LNP comprises one or more lipids select from:

□-arginyl-2,3-diamino propionic acid-N-palmityl-N-oleyl-amide trihydrochloride (Formula III):

(Formula III)

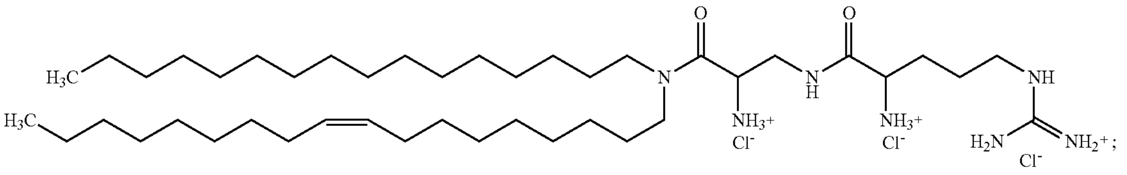

□-arginyl-2,3-diamino propionic acid-N-lauryl-N-myristyl-amide trihydrochloride (Formula IV):

(Formula IV)

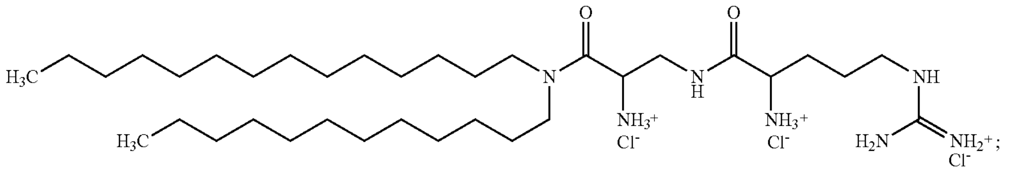

and

□-arginyl-lysine-N-lauryl-N-myristyl-amide trihydrochloride (Formula V):

(Formula V)

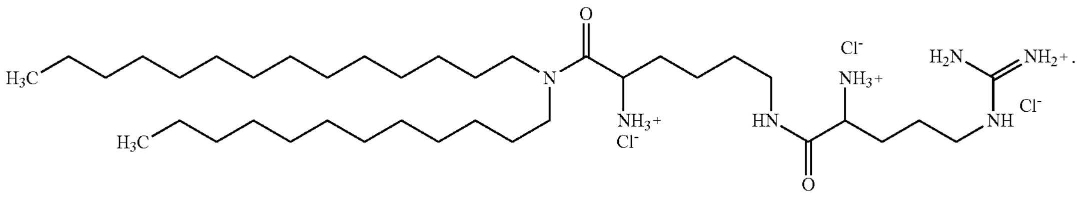

In some embodiments, the LNP also includes a constituent. By way of example, but not by way of limitation, in some embodiments, the constituent is selected from peptides, proteins, oligonucleotides, polynucleotides, nucleic acids, or a combination thereof. In some embodiments, the constituent is an antibody, e.g., a monoclonal antibody. In some embodiments, the constituent is a nucleic acid selected from, e.g., ribozymes, aptamers, spiegelmers, DNA, RNA, PNA, LNA, or a combination thereof. In some embodiments, the nucleic acid is guide RNA and/or mRNA.

In some embodiments, the constituent of the LNP comprises an mRNA encoding a CRIPSR-Cas protein. In some embodiments, the constituent of the LNP comprises an mRNA encoding a Type-II or Type-V CRIPSR-Cas protein. In some embodiments, the constituent of the LNP comprises an mRNA encoding an adenosine deaminase (which may be fused to a CRISPR-Cas protein or an adaptor protein).

In some embodiments, the constituent of the LNP further comprises one or more guide RNA. In some embodiments, the LNP is configured to deliver the aforementioned mRNA and guide RNA to vascular endothelium. In some embodiments, the LNP is configured to deliver the aforementioned mRNA and guide RNA to pulmonary endothelium. In some embodiments, the LNP is configured to deliver the aforementioned mRNA and guide RNA to liver. In some embodiments, the LNP is configured to deliver the aforementioned mRNA and guide RNA to lung. In some embodiments, the LNP is configured to deliver the aforementioned mRNA and guide RNA to hearts. In some embodiments, the LNP is configured to deliver the aforementioned mRNA and guide RNA to spleen. In some embodiments, the LNP is configured to deliver the aforementioned mRNA and guide RNA to kidney. In some embodiments, the LNP is configured to deliver the aforementioned mRNA and guide RNA to pancrea. In some embodiments, the LNP is configured to deliver the aforementioned mRNA and guide RNA to brain. In some embodiments, the LNP is configured to deliver the aforementioned mRNA and guide RNA to macrophages.

In some embodiments, the LNP also includes at least one helper lipid. In some embodiments, the helper lipid is selected from phospholipids and steroids. In some embodiments, the phospholipids are di- and/or monoester of the phosphoric acid. In some embodiments, the phospholipids are phosphoglycerides and/or sphingolipids. In some embodiments, the steroids are naturally occurring and/or synthetic compounds based on the partially hydrogenated cyclopenta[a]phenanthrene. In some embodiments, the steroids contain 21 to 30 C atoms. In some embodiments, the steroid is cholesterol. In some embodiments, the helper lipid is selected from 1,2-diphytanoyl-sn-glycero-3-phosphoethanolamine (DPhyPE), ceramide, and 1,2-dioleylsn-glycero-3-phosphoethanolamine (DOPE).

In some embodiments, the at least one helper lipid comprises a moiety selected from the group comprising a PEG moiety, a HEG moiety, a polyhydroxyethyl starch (polyHES) moiety and a polypropylene moiety. In some embodiments, the moiety has a molecule weight between about 500 to 10,000 Da or between about 2,000 to 5,000 Da. In some embodiments, the PEG moiety is selected from 1,2-distearoyl-sn-glycero-3 phosphoethanolamine, 1,2-dialkyl-sn-glycero-3-phosphoethanolamine, and Ceramide-PEG. In some embodiments, the PEG moiety has a molecular weight between about 500 to 10,000 Da or between about 2,000 to 5,000 Da. In some embodiments, the PEG moiety has a molecular weight of 2,000 Da.

In some embodiments, the helper lipid is between about 20 mol % to 80 mol % of the total lipid content of the composition. In some embodiments, the helper lipid component is between about 35 mol % to 65 mol % of the total lipid content of the LNP. In some embodiments, the LNP includes lipids at 50 mol % and the helper lipid at 50 mol % of the total lipid content of the LNP.

In some embodiments, the LNP includes any of □-3-arginyl-2,3-diaminopropionic acid-N-palmityl-N-oleyl-amide trihydrochloride, □-arginyl-2,3-diaminopropionic acid-N-lauryl-N-myristyl-amide trihydrochloride or □-arginyl-lysine-N-lauryl-N-myristyl-amide trihydrochloride in combination with DPhyPE, wherein the content of DPhyPE is about 80 mol %, 65 mol %, 50 mol % and 35 mol % of the overall lipid content of the LNP. In some embodiments, the LNP includes □-arginyl-2,3-diamino propionic acid-N-pahnityl-N-oleyl-amide trihydrochloride (lipid) and 1,2-diphytanoyl-sn-glycero-3-phosphoethanolamine (helper lipid). In some embodiments, the LNP includes □-arginyl-2,3-diamino propionic acid-N-palmityl-N-oleyl-amide trihydrochloride (lipid), 1,2-diphytanoyl-sn-glycero-3-phosphoethanolamine (first helper lipid), and 1,2-disteroyl-sn-glycero-3-phosphoethanolamine-PEG2000 (second helper lipid).

In some embodiments, the second helper lipid is between about 0.05 mol % to 4.9 mol % or between about 1 mol % to 3 mol % of the total lipid content. In some embodiments, the LNP includes lipids at between about 45 mol % to 50 mol % of the total lipid content, a first helper lipid between about 45 mol % to 50 mol % of the total lipid content, under the proviso that there is a PEGylated second helper lipid between about 0.1 mol % to 5 mol %, between about 1 mol % to 4 mol %, or at about 2 mol % of the total lipid content, wherein the sum of the content of the lipids, the first helper lipid, and of the second helper lipid is 100 mol % of the total lipid content and wherein the sum of the first helper lipid and the second helper lipid is 50 mol % of the total lipid content. In some embodiments, the LNP comprises: (a) 50 mol % of □-arginyl-2,3-diamino propionic acid-N-palmityl-N-oleyl-amide trihydrochloride, 48 mol % of 1,2-diphytanoyl-sn-glycero-3-phosphoethanolamine; and 2 mol % 1,2-distearoyl-sn-glycero-3-phosphoethanolamine-PEG2000; or (b) 50 mol % of □-arginyl-2,3-diamino propionic acid-N-palmityl-N-oleyl-amide trihydrocloride, 49 mol % 1,2-diphytanoyl-sn-glycero-3-phosphoethanolamine; and 1 mol % N(Carbonyl-methoxypolyethylenglycol-2000)-1,2-distearoyl-sn-glycero3-phosphoethanolamine, or a sodium salt thereof.

In some embodiments, the LNP contains a nucleic acid, wherein the charge ratio of nucleic acid backbone phosphates to cationic lipid nitrogen atoms is about 1: 1.5-7 or about 1:4.

In some embodiments, the LNP also includes a shielding compound, which is removable from the lipid composition under in vivo conditions. In some embodiments, the shielding compound is a biologically inert compound. In some embodiments, the shielding compound does not carry any charge on its surface or on the molecule as such. In some embodiments, the shielding compounds are polyethylenglycoles (PEGs), hydroxyethylglucose (HEG) based polymers, polyhydroxyethyl starch (polyHES) and polypropylene. In some embodiments, the PEG, HEG, polyHES, and a polypropylene weigh between about 500 to 10,000 Da or between about 2000 to 5000 Da. In some embodiments, the shielding compound is PEG2000 or PEG5000.

In some embodiments, the LNP includes at least one lipid, a first helper lipid, and a shielding compound that is removable from the lipid composition under in vivo conditions. In some embodiments, the LNP also includes a second helper lipid. In some embodiments, the first helper lipid is ceramide. In some embodiments, the second helper lipid is ceramide. In some embodiments, the ceramide comprises at least one short carbon chain substituent of from 6 to 10 carbon atoms. In some embodiments, the ceramide comprises 8 carbon atoms. In some embodiments, the shielding compound is attached to a ceramide. In some embodiments, the shielding compound is attached to a ceramide. In some embodiments, the shielding compound is covalently attached to the ceramide. In some embodiments, the shielding compound is attached to a nucleic acid in the LNP. In some embodiments, the shielding compound is covalently attached to the nucleic acid. In some embodiments, the shielding compound is attached to the nucleic acid by a linker. In some embodiments, the linker is cleaved under physiological conditions. In some embodiments, the linker is selected from ssRNA, ssDNA, dsRNA, dsDNA, peptide, S—S-linkers and pH sensitive linkers. In some embodiments, the linker moiety is attached to the 3' end of the sense strand of the nucleic acid. In some embodiments, the shielding compound comprises a pH-sensitive linker or a pH-sensitive moiety. In some embodiments, the pH-sensitive linker or pH-sensitive moiety is an anionic linker or an anionic moiety. In some embodiments, the anionic linker or anionic moiety is less anionic or neutral in an acidic environment. In some embodiments, the pH-sensitive linker or the pH-sensitive moiety is selected from the oligo (glutamic acid), oligophenolate(s) and diethylene triamine penta acetic acid.

In any of the LNP embodiments in the previous paragraph, the LNP can have an osmolality between about 50 to 600 mosmole/kg, between about 250 to 350 mosmole/kg, or between about 280 to 320 mosmole/kg, and/or wherein the LNP formed by the lipid and/or one or two helper lipids and the shielding compound have a particle size between about 20 to 200 nm, between about 30 to 100 nm, or between about 40 to 80 nm.

In some embodiments, the shielding compound provides for a longer circulation time in vivo and allows for a better biodistribution of the nucleic acid containing LNP. In some embodiments, the shielding compound prevents immediate interaction of the LNP with serum compounds or compounds of other bodily fluids or cytoplasma membranes, e.g., cytoplasma membranes of the endothelial lining of the vasculature, into which the LNP is administered. Additionally or alternatively, in some embodiments, the shielding compounds also prevent elements of the immune system stigmasterol, and a PEGylated lipid, wherein the PEGylated lipid comprises a PEG moiety, wherein the PEGylated lipid is selected from the group consisting of:

a PEGylated phosphoethanolamine of Formula VII:

(Formula VII)

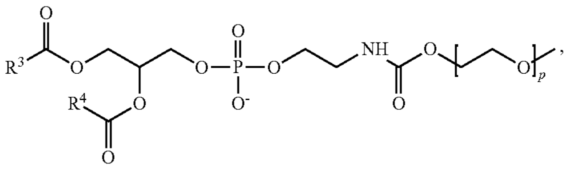

wherein $R^3$ and $R^4$ are individually and independently linear C13-C17 alkyl, and p is any integer between 15 to 130;

a PEGylated ceramide of Formula VIII:

(Formula VIII)

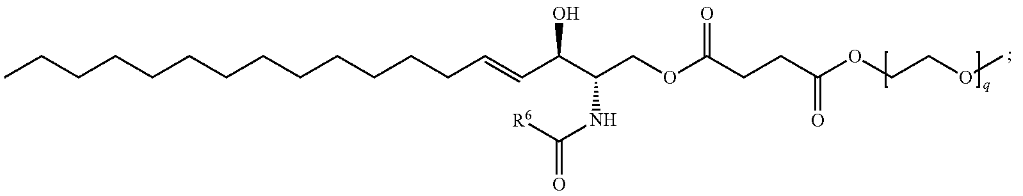

from immediately interacting with the LNP. Additionally or alternatively, in some embodiments, the shielding compound acts as an anti-opsonizing compound. Without wishing to be bound by any mechanism or theory, in some embodiments, the shielding compound forms a cover or coat that reduces the surface area of the LNP available for interaction with its environment. Additionally or alternatively, in some embodiments, the shielding compound shields the overall charge of the LNP.

In another embodiment, the LNP includes at least one cationic lipid having Formula VI:

(Formula VI)

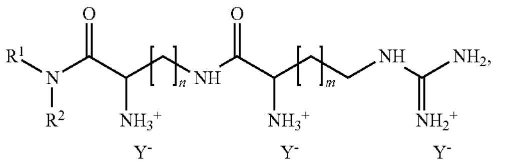

wherein n is 1, 2, 3, or 4, wherein m is 1, 2, or 3, wherein $Y^-$ is anion, wherein each of $R^1$ and $R^2$ is individually and independently selected from the group consisting of linear C12-C18 alkyl and linear C12-C18 alkenyl, a sterol compound, wherein the sterol compound is selected from the group consisting of cholesterol and wherein $R^5$ is linear C7-C15 alkyl, and q is any number between 15 to 130; and a PEGylated diacylglycerol of Formula IX:

(Formula IX)

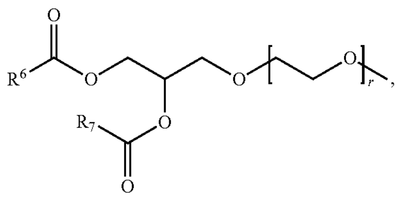

wherein each of $R^6$ and $R^7$ is individually and independently linear C11-C17 alkyl, and r is any integer from 15 to 130.

In some embodiments, R1 and R2 are different from each other. In some embodiments, R1 is palmityl and R2 is oleyl. In some embodiments, R1 is lauryl and R2 is myristyl. In some embodiments, R1 and R2 are the same. In some embodiments, each of R1 and R2 is individually and independently selected from the group consisting of C12 alkyl, C14 alkyl, C16 alkyl, C18 alkyl, C12 alkenyl, C14 alkenyl, C16 alkenyl and C18 alkenyl. In some embodiments, each of C12 alkenyl, C14 alkenyl, C16 alkenyl and C18 alkenyl comprises one or two double bonds. In some embodiments, C18 alkenyl is C18 alkenyl with one double bond between C9 and C10. In some embodiments, C18 alkenyl is cis-9-octadecyl.

In some embodiments, the cationic lipid is a compound of Formula X:

(Formula X)

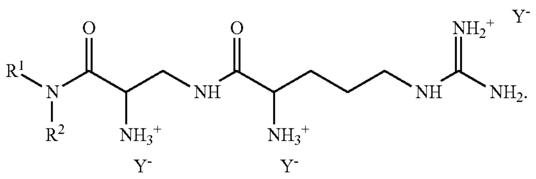

In some embodiments, $Y^-$ is selected from halogenids, acetate and trifluoroacetate. In some embodiments, the cationic lipid is □-arginyl-2,3-diamino propionic acid-N-palmityl-N-oleyl-amide trihydrochloride of Formula III:

(Formula III)

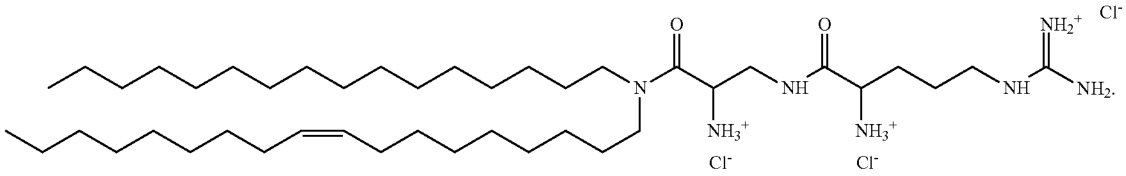

In some embodiments, the cationic lipid is □-arginyl-2,3-diamino propionic acid-N-lauryl-N-myristyl-amide trihydrochloride of Formula IV:

(Formula IV)

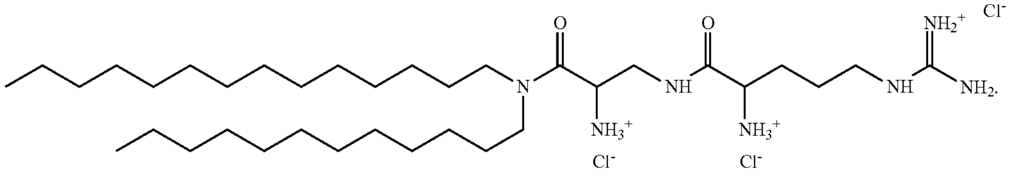

In some embodiments, the cationic lipid is □-arginyl-lysine-N-lauryl-N-myristyl-amide trihydrochloride of Formula V:

(Formula V)

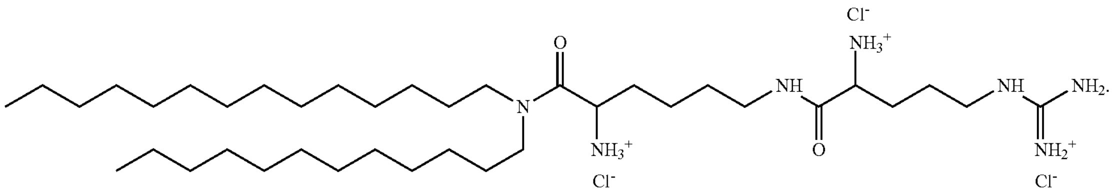

In some embodiments, the sterol compound is cholesterol. In some embodiments, the sterol compound is stigmasterin.

In some embodiments, the PEG moiety of the PEGylated lipid has a molecular weight from about 800 to 5,000 Da. In some embodiments, the molecular weight of the PEG moiety of the PEGylated lipid is about 800 Da. In some embodiments, the molecular weight of the PEG moiety of the PEGylated lipid is about 2,000 Da. In some embodiments, the molecular weight of the PEG moiety of the PEGylated lipid is about 5,000 Da. In some embodiments, the PEGylated lipid is a PEGylated phosphoethanolamine of Formula VII, wherein each of $R^3$ and $R^4$ is individually and independently linear C13-C17 alkyl, and p is any integer from 18, 19 or 20, or from 44, 45 or 46 or from 113, 114 or 115. In some embodiments, $R^3$ and $R^4$ are the same. In some embodiments, $R^3$ and $R^4$ are different. In some embodiments, each of $R^3$ and $R^4$ is individually and independently selected from the group consisting of C13 alkyl, C15 alkyl and C17 alkyl. In some embodiments, the PEGylated phosphoethanolamine of Formula VII is 1,2-distearoyl-sn-glycero-3-phosphoethanolamine-N-[methoxy(polyethylene glycol)-2000](ammonium salt):

(Formula XI)

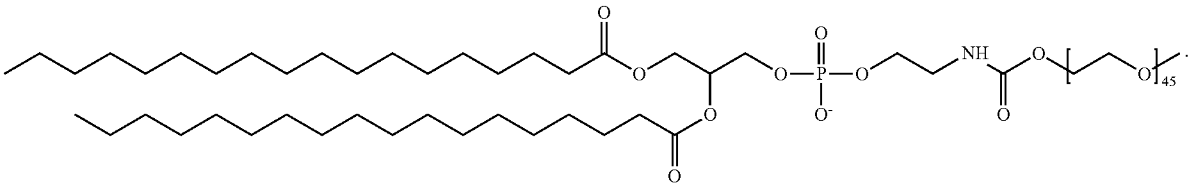

In some embodiments, the PEGylated phosphoethanolamine of Formula VII is 1,2-distearoyl-sn-glycero-3-phosphoethanolamine-N-[methoxy(polyethylene glycol)-5000](ammonium salt):

(Formula XII)

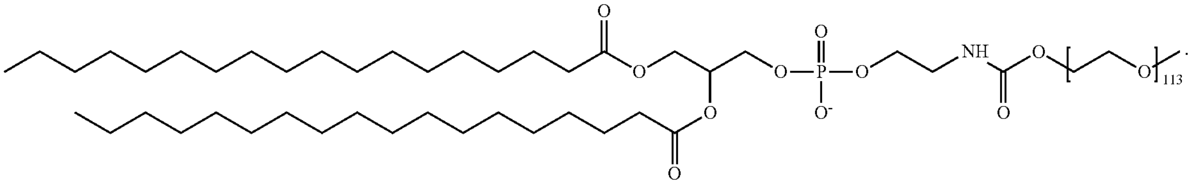

In some embodiments, the PEGylated lipid is a PEGylated ceramide of Formula VIII, wherein $R^5$ is linear C7-C15 alkyl, and q is any integer from 18, 19 or 20, or from 44, 45 or 46 or from 113, 114 or 115. In some embodiments, $R^5$ is linear C7 alkyl. In some embodiments, $R^5$ is linear C15 alkyl. In some embodiments, the PEGylated ceramide of Formula VIII is N-octanoyl-sphingosine-1-{succinyl [methoxy(polyethylene glycol)2000]}:

(Formula XIII)

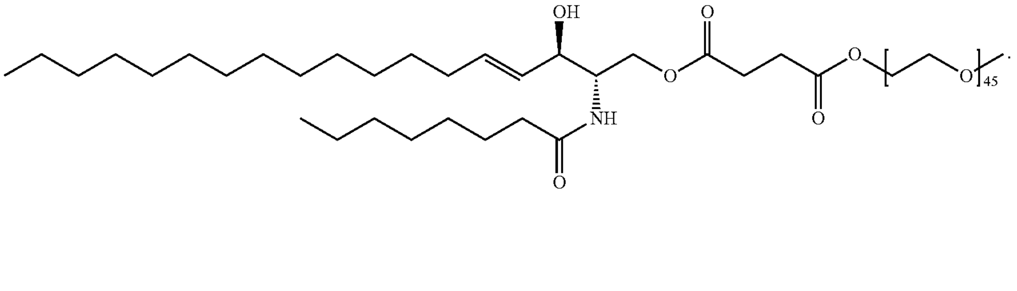

In some embodiments, the PEGylated ceramide of Formula VIII is N-palmitoyl-sphingosine-1-{succinyl[methoxy (polyethylene glycol)2000]}

(Formula XIV)

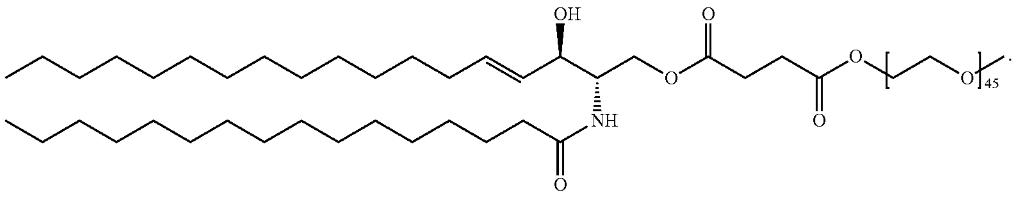

In some embodiments, the PEGylated lipid is a PEGylated diacylglycerol of Formula IX, wherein each of $R^6$ and $R^7$ is individually and independently linear C11-C17 alkyl, and r is any integer from 18, 19 or 20, or from 44, 45 or 46 or from 113, 114 or 115. In some embodiments, $R^6$ and $R^7$ are the same. In some embodiments, $R^6$ and $R^7$ are different. In some embodiments, each of $R^6$ and $R^7$ is individually and independently selected from the group consisting of linear C17 alkyl, linear C15 alkyl and linear C13 alkyl. In some embodiments, the PEGylated diacylglycerol of Formula IX 1,2-Distearoyl-sn-glycerol [methoxy(polyethylene glycol) 2000]:

(Formula XV)

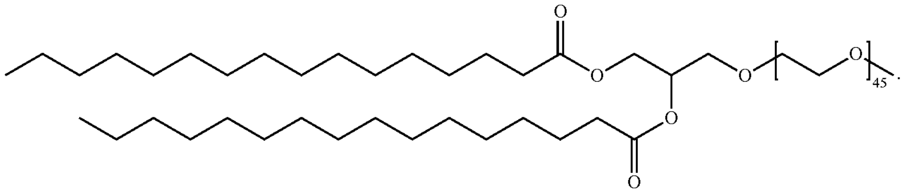

In some embodiments, the PEGylated diacylglycerol of Formula IX is 1,2-Dipalmitoyl-sn-glycerol [methoxy(polyethylene glycol)2000]:

(Formula XVI)

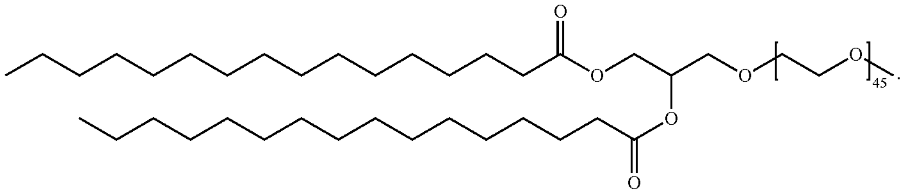

In some embodiments, the PEGylated diacylglycerol of Formula IX is:

(Formula XVII)

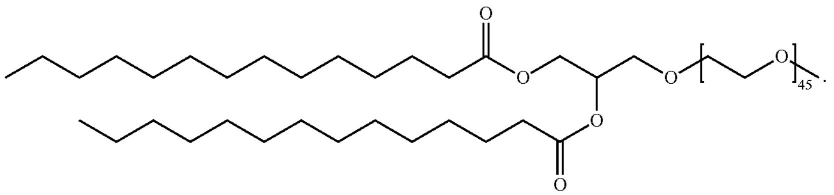

In some embodiments, the LNP includes at least one cationic lipid selected from of Formulas III, IV, and V, at least one sterol compound selected from a cholesterol and stigmasterin, and wherein the PEGylated lipid is at least one selected from Formulas XI and XII. In some embodiments, the LNP includes at least one cationic lipid selected from Formulas III, IV, and V, at least one sterol compound selected from a cholesterol and stigmasterin, and wherein the PEGylated lipid is at least one selected from Formulas XIII and XIV. In some embodiments, the LNP includes at least one cationic lipid selected from Formulas III, IV, and V, at least one sterol compound selected from a cholesterol and stigmasterin, and wherein the PEGylated lipid is at least one selected from Formulas XV and XVI. In some embodiments, the LNP includes a cationic lipid of Formula III, a cholesterol as the sterol compound, and wherein the PEGylated lipid is Formula XI.

In any of the LNP embodiments in the previous paragraph, wherein the content of the cationic lipid composition is between about 65 mole % to 75 mole %, the content of the sterol compound is between about 24 mole % to 34 mole % and the content of the PEGylated lipid is between about 0.5 mole % to 1.5 mole %, wherein the sum of the content of the cationic lipid, of the sterol compound and of the PEGylated lipid for the lipid composition is 100 mole %. In some embodiments, the cationic lipid is about 70 mole %, the content of the sterol compound is about 29 mole % and the content of the PEGylated lipid is about 1 mole %. In some embodiments, the LNP is 70 mole % of Formula III, 29 mole % of cholesterol, and 1 mole % of Formula XI.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 μg of exosomes (measured based on protein concentration) per 106 cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 μF resulted in the greatest retention of RNA and was used for all subsequent experiments.

Alvarez-Erviti et al. administered 150 μg of each BACE1 siRNA encapsulated in 150 μg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, $P<0.05$, versus 62%, $P<0.01$) in both siRNA-RVG-9R-treated and siRNARVG exosome-treated mice was observed, resulting from a significant decrease in BACE1 mRNA levels (66% [+ or −]15%, $P<0.001$ and 61% [+ or −]13% respectively, $P<0.01$). Moreover, Applicants demonstrated a significant decrease (55%, $P<0.05$) in the total [beta]-amyloid 1-42 levels, a main component of the amyloid plaques in Alzheimer's pathology, in the RVG-exosome-treated animals. The decrease observed was greater than the 0-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the AD-functionalized CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16,500 g for 30 min followed by filtration through a 0.22 mm filter. Exosomes are pelleted by ultracentrifugation at 120,000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Trojan Horse Liposomes may be used to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the AD-functionalized CRISPR Cas system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subject at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at >0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Biotechnology, Volume 28, Number 2, February 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the AD-functionalized CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11+0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. (Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the AD-functionalized CRISPR Cas system of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with CRISPR Cas instead of siRNA (see, e.g., Novobrantseva, Molecular Therapy-Nucleic Acids (2012) 1, e4; doi: 10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid nanoparticles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The AD-functionalized CRISPR Cas system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to, PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumors, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine and phosphorous containing compounds with a mixture of amine/amide or N—P(O2)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterized by undesirable cellular proliferation such as neoplasms and tumors, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumor activity may complement the activity of the agent to be delivered." The disclosures of these patent publications may be employed in conjunction with herein teachings for delivery of AD-functionalized CRISPR Cas system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of AD-functionalized CRISPR Cas system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. The creation and characterization of supercharged proteins has been reported in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116) (However, pilot experiments varying the dose of protein and RNA should be performed to optimize the procedure for specific cell lines): (1) One day before treatment, plate $1\times10^5$ cells per well in a 48-well plate. (2) On the day of treatment, dilute purified +36 GFP protein in serum-free media to a final concentration 200 nM. Add RNA to a final concentration of 50 nM. Vortex to mix and incubate at room temperature for 10 min. (3) During incubation, aspirate media from cells and wash once with PBS. (4) Following incubation of +36 GFP and RNA, add the protein-RNA complexes to cells. (5) Incubate cells with complexes at 37° C. for 4h. (6) Following incubation, aspirate the media and wash three times with 20 U/mL heparin PBS. Incubate cells with serum-containing media for a further 48 h or longer depending upon the assay for activity. (7) Analyze cells by immunoblot, qPCR, phenotypic assay, or other appropriate method.

It has been further found +36 GFP to be an effective plasmid delivery reagent in a range of cells. As plasmid DNA is a larger cargo than siRNA, proportionately more +36 GFP protein is required to effectively complex plasmids. For effective plasmid delivery, Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications: (1) One day before treatment, plate $1\times10^5$ per well in a 48-well plate. (2) On the day of treatment, dilute purified b36 GFP protein in serum-free media to a final concentration 2 mM. Add 1 mg of plasmid DNA. Vortex to mix and incubate at room temperature for 10 min. (3) During incubation, aspirate media from cells and wash once with PBS. (4) Following incubation of b36 GFP and plasmid DNA, gently add the protein-DNA complexes to cells. (5) Incubate cells with complexes at 37 C for 4h. (6) Following incubation, aspirate the media and wash with PBS. Incubate cells in serum-containing media and incubate for a further 24-48h. (7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the AD-functionalized CRISPR Cas system of the present invention. These systems in conjunction with herein teachings can be employed in the delivery of AD-functionalized CRISPR Cas system(s) or component(s) thereof or nucleic acid molecule(s) coding therefor.

Cell Penetrating Peptides (CPPs)

In yet another embodiment, cell penetrating peptides (CPPs) are contemplated for the delivery of the AD-functionalized CRISPR Cas system. CPPs are short peptides that facilitate cellular uptake of various molecular cargo (from nanosize particles to small chemical molecules and large fragments of DNA). The term "cargo" as used herein includes, but is not limited to, the group consisting of therapeutic agents, diagnostic probes, peptides, nucleic acids, antisense oligonucleotides, plasmids, proteins, particles, including nanoparticles, liposomes, chromophores, small molecules and radioactive materials. In aspects of the invention, the cargo may also comprise any component of the AD-functionalized CRISPR Cas system or the entire AD-functionalized functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs is to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include, but are not limited to, Penetratin, Tat (48-60), Transportan, and (R-AhX-R4) (Ahx=aminohexanoyl).

U.S. Pat. No. 8,372,951 provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the AD-functionalized CRISPR-Cas system or components thereof. That CPPs can be employed to deliver the AD-functionalized CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2, incorporated by reference in its entirety, wherein it is demonstrated that treatment with CPP-conjugated recombinant Cas9 protein and CPP-complexed guide RNAs lead to endogenous gene disruptions in human cell lines. In the paper, the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Aerosol Delivery

Subjects treated for a lung disease may, for example, receive a pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector.

Packaning and Promoters

The promoter used to drive CRISPR-Cas protein and optionally a functional domain (e.g., adenosine deaminase) coding nucleic acid molecule expression can include AAV ITR, which can serve as a promoter. This is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of C2c1.

For ubiquitous expression, promoters that can be used include: CMV, CAG, CBh, PGK, SV40, Ferritin heavy or light chains, etc. For brain or other CNS expression, SynapsinI can be used for all neurons, CaMKIIalpha can be used for excitatory neurons, GAD67 or GAD65 or VGAT can be used for GABAergic neurons. For liver expression, Albumin promoter can be used. For lung expression, SP-B can be used. For endothelial cells, ICAM can be used. For hematopoietic cells, IFNbeta or CD45 can be used. For Osteoblasts, the OG-2 can be used.

The promoter used to drive guide RNA can include Pol III promoters such as U6 or H1, as well as use of Pol II promoter and intronic cassettes to express guide RNA.

In certain embodiments, the CRISPR-Cas system is delivered using adeno associated virus (AAV), leukemia virus (MuMLV), lentivirus, adenovirus or other plasmid or viral vector types.

Adeno Associated Virus (AAV)

The CRISPR-Cas protein, adenosine deaminase, and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, and mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of C2c1 and adenosine deaminase can be driven by a cell-type specific promoter. For example, liver-specific expression might use the Albumin promoter and neuron-specific expression (e.g., for targeting CNS disorders) might use the Synapsin I promoter.

In terms of in vivo delivery, AAV is advantageous over other viral vectors for a couple of reasons: low toxicity (this may be due to the purification method not requiring ultra centrifugation of cell particles that can activate the immune response); and low probability of causing insertional mutagenesis because it doesn't integrate into the host genome.

AAV has a packaging limit of 4.5 or 4.75 Kb. This means that C2c1 as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore, embodiments of the invention include utilizing homologs of C2c1 that are shorter. In some embodiments, the virus capsid comprises one or more of the VP1, VP2, VP3 capsid proteins.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentiviruses

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2. G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in an ultracentrifuge for 2 hours at 24,000 rpm. Viral pellets were resuspended in 50 ul of DMEM overnight at 4° C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the AD-functionalized CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the AD-functionalized CRISPR-Cas system of the present invention. A minimum of 2.5x106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2x106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189, US20090017543; US20070054961, US20100317109. Lentiviral vectors have also been disclosed for delivery to the brain, see, e.g., US Patent Publication Nos. US20110293571, US20110293571, US20040013648, US20070025970, US20090111106 and U.S. Pat. No. 7,259,015.

Polymer-Based Particles

The systems and compositions herein may be delivered using polymer-based particles (e.g., nanoparticles). In some embodiments, the polymer-based particles may mimic a viral mechanism of membrane fusion. The polymer-based particles may be a synthetic copy of Influenza virus machinery and form transfection complexes with various types of nucleic acids (siRNA, miRNA, plasmid DNA or shRNA, mRNA) that cells take up via the endocytosis pathway, a process that involves the formation of an acidic compartment. The low pH in late endosomes acts as a chemical switch that renders the particle surface hydrophobic and facilitates membrane crossing. Once into the cytosol, the particle releases its payload for cellular action. This Active Endosome Escape technology is safe and maximizes transfection efficiency as it is using a natural uptake pathway. In some embodiments, the polymer-based particles may comprise alkylated and carboxyalkylated branched polyethylenimine. In some examples, the polymer-based particles are VIROMER, e.g., VIROMER RNAi, VIROMER RED, VIROMER mRNA, VIROMER CRISPR. Example methods of delivering the systems and compositions herein include those described in Bawage S S et al., Synthetic mRNA expressed Cas13a mitigates RNA virus infections, .biorxiv.org/content/10.1101/370460v1.full doi: doi.org/10.1101/370460, Viromer® RED, a powerful tool for transfection of keratinocytes. doi: 10.13140/

RG.2.2.16993.61281, Viromer® Transfection—Factbook 2018: technology, product overview, users' data., doi: 10.13140/RG.2.2.23912.16642.

Applications in General

The present disclosure provides methods of modifying expression of a target nucleic acid (e.g., DNA), or one or more target nucleic acids with the components and systems herein. In some embodiments, the methods comprise contacting a target nucleic acid with one or more non-naturally occurring or engineered compositions or systems herein. For example, the present disclosure provides a method of modifying a target gene of interest, the method comprising contacting a target DNA with one or more non-naturally occurring or engineered compositions comprising: i) a Cas12b effector protein from Table 1 or 2, ii) a crRNA comprising a) a 3' guide sequence that is capable of hybridizing to a target DNA sequence, and b) a 5' direct repeat sequence, and iii) a tracr RNA, whereby there is formed a CRISPR complex comprising the Cas12b effector protein complexed with the crRNA and the tracr RNA, wherein the guide sequence directs sequence-specific binding to the target RNA sequence in a cell, whereby expression of the target locus of interest is modified.

The methods may be used for modifying the expression of a target gene. The modification may alter the expression of the target gene as compared to the expression of the target gene without or before the treatment with the systems or compositions. The modification may increase the expression of the target gene as compared to the expression of the target gene without or before the treatment with the systems or compositions. The modification may decrease the expression of the target gene as compared to the expression of the target gene without or before the treatment with the systems or compositions.

In some embodiments, the methods may comprise modifying one or more bases (e.g., adenine or cytosine) in a target oligonucleotide. Such methods may comprise delivering one or more components of the base editor herein to the target oligonucleotide. In some examples, the methods comprising delivering to said target oligonucleotide: a catalytically inactive Cas12b protein; a guide molecule which comprises a guide sequence linked to a direct repeat; and an adenosine or cytidine deaminase protein or catalytic domain thereof; wherein said adenosine or cytidine deaminase protein or catalytic domain thereof is covalently or non-covalently linked to said catalytically inactive Cas12b protein or said guide molecule or is adapted to linked thereto after delivery; wherein said guide molecule forms a complex with said catalytically inactive Cas12b and directs said complex to bind said target oligonucleotide, wherein said guide sequence is capable of hybridizing with a target sequence within said target oligonucleotide to form an oligonucleotide duplex. In some embodiments, the cytosine is outside the target sequence that forms the oligonucleotide duplex, wherein the cytidine deaminase protein or catalytic domain thereof deaminates the Cytosine outside the RNA duplex, or (B) the Cytosine is within the target sequence that forms the RNA duplex, wherein the guide sequence comprises a non-pairing Adenine or Uracil at a position corresponding to the Cytosine resulting in a C-A or C-U mismatch in the RNA duplex, and wherein the cytidine deaminase protein or catalytic domain thereof deaminates the Cytosine in the RNA duplex opposite to the non-pairing Adenine or Uracil. The guide molecule forms a complex with said CRISPR effector protein and directs said complex to bind the target oligonucleotide sequence of interest, wherein the guide sequence is capable of hybridizing with a target sequence comprising the Adenine or Cytosine to form an RNA duplex; wherein the adenosine deaminase protein or catalytic domain thereof deaminates the Adenine or Cytosine in the RNA duplex.

In some embodiments, the methods and systems may be used for detecting the presence of a nucleic acid target sequence in one or more samples. In some embodiments, a system for detecting the presence of nucleic acid target sequences in one or more in vitro samples may comprise: a Cas12b protein; at least one guide polynucleotide comprising a guide sequence designed to have a degree of complementarity with the target sequence, and designed to form a complex with the Cas12b; and an oligonucleotide-based masking construct comprising a non-target sequence; wherein the Cas12b exhibits collateral nuclease activity and cleaves the non-target sequence of the oligo-nucleotide based masking construct once activated by the target sequence. In certain embodiments, a system for detecting the presence of target polypeptides in one or more in vitro samples comprising: a Cas12b protein; one or more detection aptamers, each designed to bind to one of the one or more target polypeptides, each detection aptamer comprising a masked promoter binding site or masked primer binding site and a trigger sequence template; and an oligonucleotide-based masking construct comprising a non-target sequence. A method for detecting nucleic acid sequences in one or more in vitro samples may comprise: contacting one or more samples with: i) a Cas12b effector protein ii) at least one guide polynucleotide comprising a guide sequence designed to have a degree of complementarity with the target sequence, and designed to form a complex with the Cas12b effector protein; and iii) an oligonucleotide-based masking construct comprising a non-target sequence; and wherein said Cas12 effector protein exhibits collateral nuclease activity and cleaves the non-target sequence of the oligo-nucleotide-based masking construct.

In another aspect, the present disclosure provides methods for providing an enzymatic (e.g., proteolytic) activity in a cell containing a target oligonucleotide. The methods may comprise contacting the cell(s) with a first Cas protein linked to an inactive portion of an enzyme, and a second Cas protein linked to a complementary portion of the enzyme. The activity of the enzyme is reconstituted when the inactive portion and the complementary portion of the enzyme are contacted. In some embodiments, the method of providing a proteolytic activity in a cell containing a target oligonucleotide comprises a) contacting a cell or population of cells with: i) a first Cas12b effector protein linked to an inactive portion of a proteolytic enzyme; ii) a second Cas12b effector protein linked to a complementary portion the proteolytic enzyme, wherein proteolytic activity of the proteolytic enzyme is reconstituted when the first portion and the complementary portion of the proteolytic enzyme are contacted; iii) a first guide that binds to the first Cas12b effector protein and hybridizes to a first target sequence of the RNA; and iv) a second guide that binds to the second Cas12b effector protein and hybridizes to a second target sequence of the RNA, whereby the first portion and a second portion of the proteolytic enzyme are contacted and the proteolytic activity of the proteolytic enzyme is reconstituted.

In another aspect, the present disclosure provides methods for identifying a cell containing an oligonucleotide of interest. The methods may comprise identifying the cell(s) with a first Cas protein linked to an inactive portion of a reporter, and a second Cas protein linked to a complementary portion of the reporter. The activity of the reporter is reconstituted when the inactive portion and the complementary portion of the reporter are contacted. In some embodiments, a method of identifying a cell containing an oligonucleotide of interest, the method comprising contacting the oligonucleotide in the cell with a composition which comprises: i) a first Cas12b effector protein linked to an inactive first portion of a reporter; ii) a second Cas12b effector protein linked to a complementary portion of the reporter wherein activity of the reporter is reconstituted when the first portion and the complementary portion of the reporter are contacted; iii) a first guide that binds to the first Cas12b effector protein and hybridizes to a first target sequence of the oligonucleotide; iv) a second guide that binds to the second Cas12b effector protein and hybridizes to a second target sequence of the oligonucleotide; and v) the reporter, wherein the first portion and a second portion of the reporter are contacted when the oligonucleotide of interest is present in the cell, whereby the activity of the reporter is reconstituted. In some examples, the reporter is a fluorescent protein or a luminescent protein Application in Non-Animal Organisms Application of C2c1-CRISPR System to Plants and Yeast In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for genome editing using the C2c1 system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g., those belonging to the orders Pinales, Ginkgoales, Cycadales, Araucariales, Cupressales and Gnetales.

The CRISPR-C2c1 systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*; and the genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum, Zea, Abies, Cunninghamia, Ephedra, Picea, Pinus*, and *Pseudotsuga.*

The CRISPR-C2c1 systems and methods of use can also be used over a broad range of "algae" or "algae cells"; including for example algae selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira*, and *Trichodesmium.*

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerervisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella* isabellina).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guide RNA may more often be a rate-limiting component in genome engineering of polyploid cells than in haploid cells, and thus the methods using the C2c1 CRISPRS system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2μ plasmids, yeast integrative plasmids, yeast replicative plasmids, shuttle vectors, and episomal plasmids.

Stable Integration of CRISPR-C2c1 System Components in the Genome of Plants and Plant Cells In particular embodiments, it is envisaged that the polynucleotides encoding the components of the CRISPR-C2c1 system are introduced for stable integration into the genome of a plant cell. In these embodiments, the design of the transformation vector or the expression system can be adjusted depending on for when, where and under what conditions the guide RNA and/or the C2c1 gene are expressed.

In particular embodiments, it is envisaged to introduce the components of the CRISPR-C2c1 system stably into the genomic DNA of a plant cell. Additionally or alternatively, it is envisaged to introduce the components of the CRISPR-C2c1 system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the RNA and/or C2c1 enzyme in a plant cell; a 5' untranslated region to enhance expression; an intron element to further enhance expression in certain cells, such as monocot cells; a multiple-cloning site to provide convenient restriction sites for inserting the guide RNA and/or the C2c1 gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a C2c1 CRISPR expression system comprises at least:

(a) a nucleotide sequence encoding a guide RNA (gRNA) that hybridizes with a target sequence in a plant, and wherein the guide RNA comprises a guide sequence and a direct repeat sequence, (b) a nucleotide sequence encoding a tracr RNA, and (c) a nucleotide sequence encoding a C2c1 protein, wherein components (a) or (b) or (c) are located on the same or on different constructs, and whereby the different nucleotide sequences can be under control of the same or a different regulatory element operable in a plant cell. The tracr may be fused to the guide RNA.

DNA construct(s) containing the components of the CRISPR-C2c1 system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as, but not limited to, electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome (see, e.g., Klein et al., Nature (1987), Klein et al., Bio/Technology (1992), Casas et al., Proc. Natl. Acad. Sci. USA (1993)).

In particular embodiments, the DNA constructs containing components of the CRISPR-C2c1 system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see, e.g., Fraley et al., (1985), Rogers et al., (1987) and U.S. Pat. No. 5,563,055).

Plant Promoters

In order to ensure appropriate expression in a plant cell, the components of the CRISPR-C2c1 system described herein are typically placed under control of a plant promoter, i.e., a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the C2c1 CRISPR components are expressed under the control of a constitutive promoter, such as the cauliflower mosaic virus 35S promoter. Issue-preferred promoters can be utilized to target enhanced expression in certain cell types within a particular plant tissue, for instance vascular cells in leaves or roots or in specific cells of the seed. Examples of particular promoters for use in the CRISPR-C2c1 system can be found in Kawamata et al., (1997) Plant Cell Physiol 38:792-803; Yamamoto et al., (1997) Plant J 12:255-65; Hire et al., (1992) Plant Mol Biol 20:207-18, Kuster et al., (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include, but is not limited to, sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc.), or light inducible systems (Phytochrome, LOV domains, or cryptochrome), such as a Light Inducible Transcriptional Effector (LITE) that directs changes in transcriptional activity in a sequence-specific manner. The components of a light inducible system may include a C2c1 CRISPR enzyme, a light-responsive cytochrome heterodimer (e.g., from *Arabidopsis thaliana*), and a transcriptional activation/repression domain. Further examples of inducible DNA binding proteins and methods for their use are provided in U.S. 61/736,465 and U.S. 61/721,283, which are hereby incorporated by reference in their entirety.

In particular embodiments, transient or inducible expression can be achieved by using, for example, chemical-regulated promotors, i.e., whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast targeting. In particular embodiments, it is envisaged that the CRISPR-C2c1 system is used to specifically modify chloroplast genes or to ensure expression in the chloroplast. For this purpose, use is made of chloroplast transformation methods or compartmentalization of the C2c1 CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the C2c1 CRISPR components to the plant chloroplast. This is achieved by incorporating in the expression construct a sequence encoding a chloroplast transit peptide (CTP) or plastid transit peptide, operably linked to the 5' region of the sequence encoding the C2c1 protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments, it is also desired to target the guide RNA to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the C2c1-guide RNA.

Introduction of Polynucleotides Encoding the CRISPR-C2c1 System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* species) using Cas9. Using similar tools, the methods of the CRISPR-C2c1 system described herein can be applied on *Chlamydomonas* species and other algae. In particular embodiments, C2c1 and guide RNA are introduced in algae expressed using a vector that expresses C2c1 under the control of a constitutive promoter such as Hsp70A-Rbc S2 or Beta2-tubulin. Guide RNA is optionally delivered using a vector containing T7 promoter. Alternatively, C2c1 mRNA and in vitro transcribed guide RNA can be delivered to algal cells. Electroporation protocols are available to the skilled person such as the standard recommended protocol from the GeneArt *Chlamydomonas* Engineering kit.

In particular embodiments, the endonuclease used herein is a Split C2c1 enzyme. Split C2c1 enzymes are preferentially used in Algae for targeted genome modification as has been described for Cas9 in WO 2015086795. Use of the C2c1 split system is particularly suitable for an inducible method of genome targeting and avoids the potential toxic effect of the C2c1 overexpression within the algae cell. In particular embodiments, said C2c1 split domains (RuvC domain) can be simultaneously or sequentially introduced into the cell such that said split C2c1 domain(s) process the target nucleic acid sequence in the algae cell. The reduced size of the split C2c1 compared to the wild type C2c1 allows other methods of delivery of the CRISPR system to the cells, such as the use of Cell Penetrating Peptides as described herein. This method is of particular interest for generating genetically modified algae.

Introduction of Polynucleotides Encoding C2c1 Components in Yeast Cells

In particular embodiments, the invention relates to the use of the CRISPR-C2c1 system for genome editing of yeast cells. Methods for transforming yeast cells which can be used to introduce polynucleotides encoding the CRISPR-C2c1 system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of C2c1 CRISPR System Components in Plants and Plant Cell

In particular embodiments, it is envisaged that the guide RNA and/or C2c1 gene are transiently expressed in the plant cell. In these embodiments, the CRISPR-C2c1 system can ensure modification of a target gene only when both the guide RNA and the C2c1 protein is present in a cell, such that genomic modification can further be controlled. As the expression of the C2c1 enzyme is transient, plants regenerated from such plant cells typically contain no foreign DNA. In particular embodiments the C2c1 enzyme is stably expressed by the plant cell and the guide sequence is transiently expressed.

In particular embodiments, the CRISPR-C2c1 system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., Faba bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

In particular embodiments, the vector used for transient expression of C2c1 CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the C2c1 gene can be transiently introduced into the plant cell. In such embodiments, the introduced double-stranded DNA fragments are provided in sufficient quantity to modify the cell but do not persist after a contemplated period of time has passed or after one or more cell divisions. Methods for direct DNA transfer in plants are known by the skilled artisan (see for instance Davey et al., Plant Mol Biol. 1989 September; 13(3):273-85).

In other embodiments, an RNA polynucleotide encoding the C2c1 protein is introduced into the plant cell, which is then translated and processed by the host cell generating the protein in sufficient quantity to modify the cell (in the presence of at least one guide RNA) but which does not persist after a contemplated period of time has passed or after one or more cell divisions. Methods for introducing mRNA to plant protoplasts for transient expression are known by the skilled artisan (see, for instance, in Gallie, Plant Cell Reports (1993), 13; 119-122).

Combinations of the different methods described above are also envisaged.

Delivery of C2c1 CRISPR Components to the Plant Cell

In particular embodiments, it is of interest to deliver one or more components of the CRISPR-C2c1 system directly to the plant cell. This is of interest, inter alia, for the generation of non-transgenic plants (see below). In particular embodiments, one or more of the C2c1 components is prepared outside the plant or plant cell and delivered to the cell. For instance, in particular embodiments, the C2c1 protein is prepared in vitro prior to introduction to the plant cell. C2c1 protein can be prepared by various methods known by one of skill in the art and include recombinant production. After expression, the C2c1 protein is isolated, refolded if needed, purified and optionally treated to remove any purification tags, such as a His-tag. Once crude, partially purified, or more completely purified C2c1 protein is obtained, the protein may be introduced to the plant cell.

In particular embodiments, the C2c1 protein is mixed with guide RNA targeting the gene of interest to form a pre-assembled ribonucleoprotein.

The individual components or pre-assembled ribonucleoprotein can be introduced into the plant cell via electroporation, by bombardment with C2c1-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. Nature Biotechnology, 2015; DOI: 10.1038/nbt.3389).

In particular embodiments, the CRISPR-C2c1 system components are introduced into the plant cells using particles. The components, either as protein or nucleic acid or in a combination thereof, can be uploaded onto or packaged in particles and applied to the plants (such as for instance described in WO 2008042156 and US 20130185823). In particular, embodiments of the invention comprise particles uploaded with or packed with DNA molecule(s) encoding the C2c1 protein, DNA molecules encoding the guide RNA and/or isolated guide RNA as described in WO2015089419.

Further means of introducing one or more components of the CRISPR-C2c1 system to the plant cell is by using cell penetrating peptides (CPP). Accordingly, in particular embodiments, the invention comprises compositions comprising a cell penetrating peptide linked to the C2c1 protein. In particular embodiments of the present invention, the C2c1 protein and/or guide RNA is coupled to one or more CPPs to effectively transport them inside plant protoplasts; see also Ramakrishna (20140 Genome Res. 2014 June; 24(6): 1020-7 for Cas9 in human cells). In other embodiments, the C2c1 gene and/or guide RNA are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membranes in a receptor independent manner. CPPs can be cationic peptides, peptides having hydrophobic sequences, amphipathic peptides, peptides having proline-rich and anti-microbial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecule with the target. Examples of CPP include amongst others: Tat, a nuclear transcriptional activator protein required for viral replication by HIV type1, penetratin, Kaposi fibroblast growth factor (FGF) signal peptide sequence, integrin 33 signal peptide sequence; polyarginine peptide Args sequence, Guanine rich-molecular transporters, sweet arrow peptide, etc.

Use of the CRISPR-C2c1 System to Make Genetically Modified Non-Transgenic Plants In particular embodiments, the methods described herein are used to modify endogenous genes or to modify their expression without the permanent introduction into the genome of the plant of any foreign gene, including those encoding CRISPR components, so as to avoid the presence of foreign DNA in the genome of the plant. This can be of interest as the regulatory requirements for non-transgenic plants are less rigorous.

In particular embodiments, this is ensured by transient expression of the C2c1 CRISPR components. In particular embodiments, one or more of the CRISPR components are expressed on one or more viral vectors which produce sufficient C2c1 protein and guide RNA to consistently steadily ensure modification of a gene of interest, according to a method described herein.

In particular embodiments, transient expression of C2c1 CRISPR constructs is ensured in plant protoplasts and thus not integrated into the genome. The limited window of expression can be sufficient to allow the CRISPR-C2c1 system to ensure modification of a target gene as described herein.

In particular embodiments, the different components of the CRISPR-C2c1 system are introduced in the plant cell, protoplast, or plant tissue either separately or in mixture, with the aid of particulate delivering molecules such as particles or CPP molecules as described herein above.

The expression of the C2c1 CRISPR components can induce targeted modification of the genome, either by direct activity of the C2c1 nuclease and optionally introduction of template DNA or by modification of genes targeted using the CRISPR-C2c1 system as described herein. The different strategies described herein above allow C2c1-mediated targeted genome editing without requiring the introduction of the C2c1 CRISPR components into the plant genome. Components which are transiently introduced into the plant cell are typically removed upon crossing.

Detecting Modifications in the Plant Genome-Selectable Markers

In particular embodiments, where the method involves modification of an endogenous target gene of the plant genome, any suitable method can be used to determine, after the plant, plant part or plant cell is infected or transfected with the CRISPR-C2c1 system, whether gene targeting or targeted mutagenesis has occurred at the target site. Where the method involves introduction of a transgene, a transformed plant cell, callus, tissue, or plant may be identified and isolated by selecting or screening the engineered plant material for the presence of the transgene or for traits encoded by the transgene. Physical and biochemical methods may be used to identify plant or plant cell transformants containing inserted gene constructs or an endogenous DNA modification. These methods include but are not limited to: 1) Southern analysis or PCR amplification for detecting and determining the structure of the recombinant DNA insert or modified endogenous genes; 2) Northern blot, S1 RNase protection, primer-extension or reverse transcriptase-PCR amplification for detecting and examining RNA transcripts of the gene constructs; 3) enzymatic assays for detecting enzyme or ribozyme activity, where such gene products are encoded by the gene construct or expression is affected by the genetic modification; and 4) protein gel electrophoresis, Western blot techniques, immunoprecipitation, or enzyme-linked immunoassays, where the gene construct or endogenous gene products are proteins. Additional techniques, such as in situ hybridization, enzyme staining, and immunostaining, also may be used to detect the presence or expression of the recombinant construct or detect a modification of endogenous gene in specific plant organs and tissues. The methods for doing all these assays are well known to those skilled in the art.

Additionally (or alternatively), the expression system encoding the C2c1 CRISPR components is typically designed to comprise one or more selectable or detectable markers that provide a means to isolate or efficiently select cells that contain and/or have been modified by the CRISPR-C2c1 system at an early stage and on a large scale.

In the case of *Agrobacterium*-mediated transformation, the marker cassette may be adjacent to or between flanking T-DNA borders and contained within a binary vector. In another embodiment, the marker cassette may be outside of the T-DNA. A selectable marker cassette may also be within or adjacent to the same T-DNA borders as the expression cassette or may be somewhere else within a second T-DNA on the binary vector (e.g., a 2 T-DNA system).

For particle bombardment or with protoplast transformation, the expression system can comprise one or more isolated linear fragments or may be part of a larger construct that might contain bacterial replication elements, bacterial selectable markers or other detectable elements. The expression cassette(s) comprising the polynucleotides encoding the guide and/or C2c1 may be physically linked to a marker cassette or may be mixed with a second nucleic acid molecule encoding a marker cassette. The marker cassette is comprised of necessary elements to express a detectable or selectable marker that allows for efficient selection of transformed cells.

The selection procedure for the cells based on the selectable marker will depend on the nature of the marker gene. In particular embodiments, use is made of a selectable marker, i.e., a marker which allows a direct selection of the cells based on the expression of the marker. A selectable marker can confer positive or negative selection and is conditional or non-conditional on the presence of external substrates (Miki et al. 2004, 107(3): 193-232). Most commonly, antibiotic or herbicide resistance genes are used as a marker, whereby selection is be performed by growing the engineered plant material on media containing an inhibitory amount of the antibiotic or herbicide to which the marker gene confers resistance. Examples of such genes are genes that confer resistance to antibiotics, such as hygromycin (hpt) and kanamycin (nptII), and genes that confer resistance to herbicides, such as phosphinothricin (bar) and chlorosulfuron (als).

Transformed plants and plant cells may also be identified by screening for the activities of a visible marker, typically an enzyme capable of processing a colored substrate (e.g., the β-glucuronidase, luciferase, B or C1 genes). Such selection and screening methodologies are well known to those skilled in the art.

Plant Cultures and Regeneration

In particular embodiments, plant cells which have a modified genome and that are produced or obtained by any of the methods described herein, can be cultured to regenerate a whole plant which possesses the transformed or modified genotype and thus the desired phenotype. Conventional regeneration techniques are well known to those skilled in the art. Particular examples of such regeneration techniques rely on manipulation of certain phytohormones in a tissue culture growth medium, and typically relying on a biocide and/or herbicide marker which has been introduced together with the desired nucleotide sequences. In further particular embodiments, plant regeneration is obtained from cultured protoplasts, plant callus, explants, organs, pollens, embryos, or parts thereof (see e.g., Evans et al. (1983), Handbook of Plant Cell Culture, Klee et al (1987) Ann. Rev. of Plant Phys.).

In particular embodiments, transformed or improved plants as described herein can be self-pollinated to provide seed for homozygous improved plants of the invention (homozygous for the DNA modification) or crossed with non-transgenic plants or different improved plants to provide seed for heterozygous plants. Where a recombinant DNA was introduced into the plant cell, the resulting plant of such a crossing is a plant which is heterozygous for the recombinant DNA molecule. Both such homozygous and heterozygous plants obtained by crossing from the improved plants and comprising the genetic modification (which can be a recombinant DNA) are referred to herein as "progeny". Progeny plants are plants descended from the original transgenic plant and containing the genome modification or recombinant DNA molecule introduced by the methods provided herein. Alternatively, genetically modified plants can be obtained by one of the methods described supra using the Cfp1 enzyme whereby no foreign DNA is incorporated into the genome. Progeny of such plants, obtained by further breeding may also contain the genetic modification. Breedings are performed by any breeding methods that are commonly used for different crops (e.g., Allard, Principles of Plant Breeding, John Wiley & Sons, NY, U. of CA, Davis, CA, 50-98 (1960).

Generation of Plants with Enhanced Agronomic Traits

The C2c1 based CRISPR systems provided herein can be used to introduce targeted double-strand or single-strand breaks and/or to introduce gene activator and or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used for high-precision engineering of plants with improved characteristics, including enhanced nutritional quality, increased resistance to diseases and resistance to biotic and abiotic stress, and increased production of commercially valuable plant products or heterologous compounds.

In particular embodiments, the CRISPR-C2c1 system as described herein is used to introduce targeted double-strand breaks (DSB) in an endogenous DNA sequence. The DSB activates cellular DNA repair pathways, which can be harnessed to achieve desired DNA sequence modifications near the break site. This is of interest where the inactivation or modification of endogenous genes can confer or contribute to a desired trait. In some embodiments, homologous recombination (HR) with a template sequence is promoted at the site of the DSB, in order to introduce a gene of interest. In some embodiments, HR-independent recombination is promoted at the site of DSB in order to introduce a sequence or gene of interest at the staggered DSB. In particular embodiments, the CRISPR-C2c1 system generates staggered DSBs with 5' overhangs. In certain particular embodiments, the CRISPR-C2c1 system comprises insert template sequence in the guide sequence and introduces specific DNA inserts at the staggered DSBs.

In particular embodiments, the CRISPR-C2c1 system may be used as a generic nucleic acid binding protein with fusion to or being operably linked to a functional domain for activation and/or repression of endogenous plant genes. Exemplary functional domains may include, but are not limited to, RNA or DNA deaminase, translational initiator, translational activator, translational repressor, nucleases, in particular ribonucleases, a spliceosome, beads, a light inducible/controllable domain or a chemically inducible/controllable domain. Typically in these embodiments, the C2c1 protein comprises at least one mutation, such that it has no more than 5% of the activity of the C2c1 protein not having the at least one mutation; the guide RNA comprises a guide sequence capable of hybridizing to a target sequence.

The methods described herein generally result in the generation of "improved plants" in that they have one or more desirable traits compared to the wildtype plant. In particular embodiments, the plants, plant cells or plant parts obtained are transgenic plants, comprising an exogenous DNA sequence incorporated into the genome of all or part of the cells of the plant. In particular embodiments, non-transgenic genetically modified plants, plant parts or cells are obtained, in that no exogenous DNA sequence is incorporated into the genome of any of the plant cells of the plant. In such embodiments, the improved plants are non-transgenic. Where only the modification of an endogenous gene is ensured and no foreign genes are introduced or maintained in the plant genome, the resulting genetically modified crops contain no foreign genes and can thus basically be considered non-transgenic. The different applications of the CRISPR-C2c1 system for plant genome editing are described more in detail below:

a) Introduction of One or More Foreign Genes to Confer an Agricultural Trait of Interest The invention provides methods of genome editing or modifying sequences associated with or at a target locus of interest wherein the method comprises introducing a C2c1 effector protein complex into a plant cell, whereby the C2c1 effector protein complex effectively functions to integrate a DNA insert, e.g., encoding a foreign gene of interest, into the genome of the plant cell. In some embodiments, the integration of the DNA insert is facilitated by HR with an exogenously introduced DNA template or repair template. In some preferred embodiments, the integration of the DNA insert is facilitated by HR-independent integration (e.g., NHEJ). Typically, the exogenously introduced DNA template or repair template is delivered together with the C2c1 effector protein complex or one component or a polynucleotide vector for expression of a component of the complex.

The CRISPR-C2c1 systems provided herein allow for targeted gene delivery. It has become increasingly clear that the efficiency of expressing a gene of interest is to a great extent determined by the location of integration into the genome. The present methods allow for targeted integration of the foreign gene into a desired location in the genome. The location can be selected based on information of previously generated events or can be selected by methods disclosed elsewhere herein.

In particular embodiments, the methods provided herein include (a) introducing into the cell a C2c1 CRISPR complex comprising a guide RNA, comprising a direct repeat and a guide sequence, wherein the guide sequence hybridizes to a target sequence that is endogenous to the plant cell; (b) introducing into the plant cell a C2c1 effector molecule which complexes with the guide RNA when the guide sequence hybridizes to the target sequence and induces a double strand break at or near the sequence to which the guide sequence is targeted; and (c) introducing into the cell a nucleotide sequence encoding an HDR repair template which encodes the gene of interest and which is introduced into the location of the DS break as a result of HDR. In particular embodiments, the step of introducing can include delivering to the plant cell one or more polynucleotides encoding C2c1 effector protein, the guide RNA and the repair template. In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the C2c1 effector protein, the guide RNA and the repair template, where the delivering is via *Agrobacterium*. The nucleic acid sequence encoding the C2c1 effector protein can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the repair template i.e., the gene of interest, has been introduced. In particular embodiments, the methods include the step of regenerating a plant from the plant cell. In further embodiments, the methods include cross breeding the plant to obtain a genetically desired plant lineage. Examples of foreign genes encoding a trait of interest are listed below.

b) Editing of Endogenous Genes to Confer an Agricultural Trait of Interest

The invention provides methods of genome editing or modifying sequences associated with or at a target locus of interest wherein the method comprises introducing a C2c1 effector protein complex into a plant cell, whereby the C2c1 complex modifies the expression of an endogenous gene of the plant. This can be achieved in different ways. In particular embodiments, the elimination of expression of an endogenous gene is desirable and the C2c1 CRISPR complex is used to target and cleave an endogenous gene so as to modify gene expression. In these embodiments, the methods provided herein include (a) introducing into the plant cell a C2c1 CRISPR complex comprising a guide RNA, comprising a direct repeat and a guide sequence, wherein the guide sequence hybridizes to a target sequence within a gene of interest in the genome of the plant cell; and (b) introducing into the cell a C2c1 effector protein, which upon binding to the guide RNA comprises a guide sequence that is hybridized to the target sequence, ensures a double strand break at or near the sequence to which the guide sequence is targeted; In particular embodiments, the step of introducing can include delivering to the plant cell one or more polynucleotides encoding C2c1 effector protein and the guide RNA.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the C2c1 effector protein and the guide RNA, where the delivering is via *Agrobacterium*. The polynucleotide sequence encoding the components of the CRISPR-C2c1 system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage.

In particular embodiments of the methods described above, disease resistant crops are obtained by targeted mutation of disease susceptibility genes or genes encoding negative regulators (e.g., Mlo gene) of plant defense genes. In a particular embodiment, herbicide-tolerant crops are generated by targeted substitution of specific nucleotides in plant genes such as those encoding acetolactate synthase (ALS) and protoporphyrinogen oxidase (PPO). In particular embodiments, drought and salt tolerant crops are generated by targeted mutation of genes encoding negative regulators of abiotic stress tolerance, low amylose grains by targeted mutation of Waxy gene, rice or other grains with reduced rancidity by targeted mutation of major lipase genes in aleurone layer, etc. A more extensive list of endogenous genes encoding a traits of interest are listed below.

c) Modulating of Endogenous Genes by the CRISPR-C2c1 System to Confer an Agricultural Trait of Interest Also provided herein are methods for modulating (i.e., activating or repressing) endogenous gene expression using the C2c1 protein provided herein. Such methods make use of distinct RNA sequence(s) which are targeted to the plant genome by the C2c1 complex. More particularly the distinct RNA sequence(s) bind to two or more adaptor proteins (e.g., aptamers) whereby each adaptor protein is associated with one or more functional domains and wherein at least one of the one or more functional domains associated with the adaptor protein have one or more activities comprising deaminase activity, methylase activity, demethylase activity, transcription activation activity, transcription repression activity, transcription release factor activity, histone modification activity, DNA integration activity RNA cleavage activity, DNA cleavage activity or nucleic acid binding activity. The functional domains are used to modulate expression of an endogenous plant gene so as to obtain the desired trait. Typically, in these embodiments, the C2c1 effector protein has one or more mutations such that it has no more than 5% of the nuclease activity of the C2c1 effector protein not having the at least one mutation.

In particular embodiments, the methods provided herein include the steps of (a) introducing into the cell a C2c1 CRISPR complex comprising a tracr RNA, a guide RNA, comprising a direct repeat and a guide sequence, wherein the guide sequence hybridizes to a target sequence that is endogenous to the plant cell; and (b) introducing into the plant cell a C2c1 effector molecule which complexes with the guide RNA when the guide sequence hybridizes to the target sequence; and wherein either the guide RNA is modified to comprise a distinct RNA sequence (aptamer) binding to a functional domain and/or the C2c1 effector protein is modified in that it is linked to a functional domain. In particular embodiments, the step of introducing can include delivering to the plant cell one or more polynucleotides encoding the (modified) C2c1 effector protein and the (modified) guide RNA. The details the components of the CRISPR-C2c1 system for use in these methods are described elsewhere herein.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the C2c1 effector protein and the guide RNA, where the delivering is via *Agrobacterium*. The nucleic acid sequence encoding the one or more components of the CRISPR-C2c1 system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage. A more extensive list of endogenous genes encoding traits of interest are listed below.

Use of C2c1 to Modify Polyploid Plants

Many plants are polyploid, which means they carry duplicate copies of their genomes—sometimes as many as six, such as in wheat. The methods according to the present invention, which make use of the C2c1 CRISPR effector protein, can be "multiplexed" to affect all copies of a gene, or to target dozens of genes at once. For instance, in particular embodiments, the methods of the present invention are used to simultaneously ensure a loss of function mutation in different genes responsible for suppressing defenses against a disease. In particular embodiments, the methods of the present invention are used to simultaneously suppress the expression of the TaMLO-A1, TaMLO-B1 and TaMLO-D1 nucleic acid sequence in a wheat plant cell and regenerating a wheat plant therefrom, in order to ensure that the wheat plant is resistant to powdery mildew (see also WO2015109752).

Exemplary Genes Conferring Agronomic Traits

As described herein above, in particular embodiments, the invention encompasses the use of the CRISPR-C2c1 system as described herein for the insertion of a DNA of interest, including one or more plant expressible gene(s). In further particular embodiments, the invention encompasses methods and tools using the C2c1 system as described herein for partial or complete deletion of one or more plant expressed gene(s). In other further particular embodiments, the invention encompasses methods and tools using the C2c1 system as described herein to ensure modification of one or more plant-expressed genes by mutation, substitution, and/or insertion of one of more nucleotides. In other particular embodiments, the invention encompasses the use of CRISPR-C2c1 system as described herein to ensure modification of expression of one or more plant-expressed genes by specific modification of one or more of the regulatory elements directing expression of said genes.

In particular embodiments, the invention encompasses methods which involve the introduction of exogenous genes and/or the targeting of endogenous genes and their regulatory elements, such as listed below:

1. Genes that Confer Resistance to Pests or Diseases:

Plant disease resistance genes. A plant can be transformed with cloned resistance genes to engineer plants that are resistant to specific pathogen strains. See, e.g., Jones et al., Science 266:789 (1994) (cloning of the tomato Cf-9 gene for resistance to *Cladosporium fulvum*); Martin et al., Science 262:1432 (1993) (tomato Pto gene for resistance to *Pseudomonas syringae* pv. tomato encodes a protein kinase); Mindrinos et al., Cell 78:1089 (1994) (Arabidops may be RSP2 gene for resistance to *Pseudomonas syringae*). A plant gene that is upregulated or down regulated during pathogen infection can be engineered for pathogen resistance. See, e.g., Thomazella et al., bioRxiv 064824; doi: doi.org/10.1101/064824 Epub. Jul. 23, 2016 (tomato plants with deletions in the SlDMR6-1 which is normally upregulated during pathogen infection).

Genes conferring resistance to a pest, such as soybean cyst nematode. See e.g., PCT Application WO 96/30517; PCT Application WO 93/19181.

*Bacillus thuringiensis* proteins see, e.g., Geiser et al., Gene 48:109 (1986).

Lectins, see, for example, Van Damme et al., Plant Molec. Biol. 24:25 (1994).

Vitamin-binding protein, such as avidin, see PCT application US93/06487, teaching the use of avidin and avidin homologues as larvicides against insect pests.

Enzyme inhibitors such as protease or proteinase inhibitors or amylase inhibitors. See, e.g., Abe et al., J. Biol. Chem. 262:16793 (1987), Huub et al., Plant Molec. Biol. 21:985 (1993)), Sumitani et al., Biosci. Biotech. Biochem. 57:1243 (1993) and U.S. Pat. No. 5,494,813.

Insect-specific hormones or pheromones such as ecdysteroid or juvenile hormone, a variant thereof, a mimetic based thereon, or an antagonist or agonist thereof. See, for example Hammock et al., Nature 344:458 (1990).

Insect-specific peptides or neuropeptides which, upon expression, disrupts the physiology of the affected pest. For example, Regan, J. Biol. Chem. 269:9 (1994) and Pratt et al., Biochem. Biophys. Res. Comm. 163:1243 (1989). See also U.S. Pat. No. 5,266,317.

Insect-specific venom produced in nature by a snake, a wasp, or any other organism. For example, see Pang et al., Gene 116: 165 (1992).

Enzymes responsible for a hyperaccumulation of a monoterpene, a sesquiterpene, a steroid, hydroxamic acid, a phenylpropanoid derivative or another nonprotein molecule with insecticidal activity.

Enzymes involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See PCT application WO93/02197, Kramer et al., Insect Biochem. Molec. Biol. 23:691 (1993) and Kawalleck et al., Plant Molec. Biol. 21:673 (1993).

Molecules that stimulate signal transduction. For example, see Botella et al., Plant Molec. Biol. 24:757 (1994), and Griess et al., Plant Physiol. 104:1467 (1994).

Viral-invasive proteins or a complex toxin derived therefrom. See Beachy et al., Ann. rev. Phytopathol. 28:451 (1990).

Developmental-arrestive proteins produced in nature by a pathogen or a parasite. See Lamb et al., Bio/Technology 10:1436 (1992) and Toubart et al., Plant J. 2:367 (1992).

A developmental-arrestive protein produced in nature by a plant. For example, Logemann et al., Bio/Technology 10:305 (1992).

In plants, pathogens are often host-specific. For example, some *Fusarium* species will cause tomato wilt but attacks only tomato, and other *Fusarium* species attack only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible or there can be partial resistance against all races of a pathogen, typically controlled by many genes and/or also complete resistance to some races of a pathogen but not to other races. Such resistance is typically controlled by a few genes. Using methods and components of the CRISPR-C2c1 system, a new tool now exists to induce specific mutations in anticipation hereon. Accordingly, one can analyze the genome of sources of resistance genes, and in plants having desired characteristics or traits, use the method and components of the CRISPR-C2c1 system to induce the rise of resistance genes. The present systems can do so with more precision than previous mutagenic agents and hence accelerate and improve plant breeding programs.

2. Genes Involved in Plant Diseases

Genes involved in plant diseases. A plant can be transformed with the CRISPR-C2c1 system that modify disease susceptible or related genes to engineer plants that are resistant to specific pathogen strains. For example, plant SWEET genes encoding putative sugar transporters are known to be induced by TAL Effectors from rice-pathogenic *Xanthomonas oryzae*, resulting in enhanced spreading of pathogen infection. See Streubel et al, New Phytologist, 2013 November; 200(3):808-19. doi: 10.1111/nph.12411. Epub 2013 Jul. 24. The CsLOB of citrus is known to be induced by TAL Effectors involved in citrus disease, such as citrus cranker.

The invention also provides a method of modifying a locus of interest in a plant cell comprising contacting the cell with any of the herein-described engineered CRISPR enzymes (e.g., engineered Cas effector module), compositions or any of the herein-described systems or vector systems, or wherein the cell comprises any of the herein-described CRISPR complexes present within the cell. In certain embodiments, the plant cell may comprise an A/T rich genome. In some embodiments, the cell genome comprises T-rich PAMs. In particular embodiments, the PAM is 5'-TTN-3' or 5'-ATTN-3'. In particular embodiments, the modified locus is related to plant disease. In a particular embodiment, the plant disease is related to pathogen susceptibility. In a particular embodiment, the modified locus comprises a SWEET locus or a CsLOB locus. In a particular embodiment, the plant disease is citrus cranker or rice blight disease. In some embodiments, the cell genome comprises T-rich PAMs. In particular embodiments, the PAM is 5'-TTN-3' or 5'-ATTN-3'. In some embodiments, the CRISPR-Cas system is a CRISPR-C2c1 system. In some embodiments, the locus of interest is modified by the C2c1 effector protein by introducing a staggered cut with a 5' overhang. In particular embodiments, the 5' overhang is 7 nt. In some embodiments, the locus of interest is modified by a single nucleotide deletion or mutation. In some embodiments, the locus of interest is modified by a mutation or deletion of less than 50 nt. In some embodiments, the locus of interest is modified by a staggered cut with a 5' overhang introduced by the CRISPR-C2c1 system with HDR. In some embodiments, the locus of interest is modified by a staggered cut with a 5' overhang introduced by the CRISPR-C2c1 system with NHEJ. In some embodiments, the locus of interest is modified by a staggered cut with a 5' overhang introduced by the CRISPR-C2c1 system in the distal end of PAM, followed by repair with HDR. In some embodiments, the locus of interest is modified by insertion of an exogenous DNA sequence introduced by the CRISPR-C2c1 system at the 5' overhang with HDR. In preferred embodiments, the locus of interest is modified by insertion of an exogenous DNA sequence introduced by the CRISPR-C2c1 system at the 5' overhang with HDR.

Genes involved in plant diseases, such as those listed in WO 2013046247:

Rice diseases: *Magnaporthe grisea, Cochliobolus miyabeanus, Rhizoctonia solani, Gibberella fujikuroi*; Wheat diseases: *Erysiphe graminis, Fusarium graminearum, F. avenaceum, F. culmorum, Microdochium nivale, Puccinia striiformis, P. graminis, P. recondita, Micronectriella nivale, Typhula* sp., *Ustilago tritici, Tilletia caries, Pseudocercosporella herpotrichoides, Mycosphaerella graminicola, Stagonospora nodorum, Pyrenophora tritici-repentis*; Barley diseases: *Erysiphe graminis, Fusarium graminearum, F. avenaceum, F. culmorum, Microdochium nivale, Puccinia striiformis, P. graminis, P. hordei, Ustilago nuda, Rhynchosporium secalis, Pyrenophora teres, Cochliobolus sativus, Pyrenophora graminea, Rhizoctonia solani*; Maize diseases: *Ustilago maydis, Cochliobolus heterostrophus, Gloeocercospora sorghi, Puccinia polysora, Cercospora zeae-maydis, Rhizoctonia solani;*

Citrus diseases: *Diaporthe citri, Elsinoe fawcetti, Penicillium digitatum, P. italicum, Phytophthora parasitica, Phytophthora citrophthora*; Apple diseases: *Monilinia mali, Valsa ceratosperma, Podosphaera leucotricha, Alternaria alternata* apple pathotype, *Venturia inaequalis, Colletotrichum acutatum, Phytophtora cactorum;*

Pear diseases: *Venturia nashicola, V. pirina, Alternaria alternata* Japanese pear pathotype, *Gymnosporangium haraeanum, Phytophtora cactorum;*

Peach diseases: *Monilinia fructicola, Cladosporium carpophilum, Phomopsis* sp.;

Grape diseases: *Elsinoe ampelina, Glomerella cingulata, Uninula necator, Phakopsora ampelopsidis, Guignardia bidwellii, Plasmopara viticola;*

Persimmon diseases: *Gloesporium kaki, Cercospora kaki, Mycosphaerela nawae;*

Gourd diseases: *Colletotrichum lagenarium, Sphaerotheca fuliginea, Mycosphaerella melonis, Fusarium oxysporum, Pseudoperonospora cubensis, Phytophthora* sp., *Pythium* sp.;

Tomato diseases: *Alternaria solani, Cladosporium fulvum, Phytophthora infestans; Pseudomonas syringae* pv. Tomato; *Phytophthora capsici; Xanthomonas*

Eggplant diseases: *Phomopsis vexans, Erysiphe cichoracearum*; Brassicaceous vegetable diseases: *Alternaria japonica, Cercosporella brassicae, Plasmodiophora brassicae, Peronospora parasitica;*

Welsh onion diseases: *Puccinia allii, Peronospora destructor;*

Soybean diseases: *Cercospora kikuchii, Elsinoe glycines, Diaporthe phaseolorum* var. *sojae, Septoria glycines, Cercospora sojina, Phakopsora pachyrhizi, Phytophthora sojae, Rhizoctonia solani, Corynespora casiicola, Sclerotinia sclerotiorum;*

Kidney bean diseases: *Colletrichum lindemthianum;*

Peanut diseases: *Cercospora personata, Cercospora arachidicola, Sclerotium rolfsii;*

Pea diseases pea: *Erysiphe pisi;*

Potato diseases: *Alternaria solani, Phytophthora infestans, Phytophthora erythroseptica, Spongospora subterranean*, f. sp. *Subterranean;*

Strawberry diseases: *Sphaerotheca humuli, Glomerella cingulata;*

Tea diseases: *Exobasidium reticulatum, Elsinoe leucospila, Pestalotiopsis* sp., *Colletotrichum theae-sinensis;*

Tobacco diseases: *Alternaria longipes, Erysiphe cichoracearum, Colletotrichum tabacum, Peronospora tabacina, Phytophthora nicotianae;*

Rapeseed diseases: *Sclerotinia sclerotiorum, Rhizoctonia solani;*

Cotton diseases: *Rhizoctonia solani;*

Beet diseases: *Cercospora beticola, Thanatephorus cucumeris, Thanatephorus cucumeris, Aphanomyces cochlioides;*

Rose diseases: *Diplocarpon rosae, Sphaerotheca pannosa, Peronospora sparsa;*

Diseases of *chrysanthemum* and *asteraceae: Bremia lactuca, Septoria chrysanthemi-indici, Puccinia horiana;*
Diseases of various plants: *Pythium aphanidermatum, Pythium debarianum, Pythium graminicola, Pythium irregulare, Pythium ultimum, Botrytis cinerea, Sclerotinia sclerotiorum;*
Radish diseases: *Alternaria brassicicola;*
*Zoysia* diseases: *Sclerotinia homeocarpa, Rhizoctonia solani;*
Banana diseases: *Mycosphaerella fijiensis, Mycosphaerella musicola;*
Sunflower diseases: *Plasmopara halstedii;*
Seed diseases or diseases in the initial stage of growth of various plants caused by *Aspergillus* spp., *Penicillium* spp., *Fusarium* spp., *Gibberella* spp., *Tricoderma* spp., *Thielaviopsis* spp., *Rhizopus* spp., *Mucor* spp., *Corticium* spp., *Rhoma* spp., *Rhizoctonia* spp., *Diplodia* spp., or the like;
Virus diseases of various plants mediated by *Polymixa* spp., *Olpidium* spp., or the like.

3. Examples of Genes that Confer Resistance to Herbicides:

Resistance to herbicides that inhibit the growing point or meristem, such as an imidazolinone or a sulfonylurea, for example, by Lee et al., EMBO J. 7:1241 (1988), and Miki et al., Theor. Appl. Genet. 80:449 (1990), respectively.

Glyphosate tolerance (resistance conferred by, e.g., mutant 5-enolpyruvylshikimate-3-phosphate synthase (EPSPs) genes, aroA genes and glyphosate acetyl transferase (GAT) genes, respectively), or resistance to other phosphono compounds such as by glufosinate (phosphinothricin acetyl transferase (PAT) genes from *Streptomyces* species, including *Streptomyces hygroscopicus* and *Streptomyces viridichromogenes*), and to pyridinoxy or phenoxy proprionic acids and cyclohexones by ACCase inhibitor-encoding genes. See, for example, U.S. Pat. Nos. 4,940,835 and 6,248,876, 4,769,061, EP No. 0 333 033 and U.S. Pat. No. 4,975,374. See also EP No. 0242246, DeGreef et al., Bio/Technology 7:61 (1989), Marshall et al., Theor. Appl. Genet. 83:435 (1992), WO 2005012515 to Castle et. al. and WO 2005107437.

Resistance to herbicides that inhibit photosynthesis, such as a triazine (psbA and gs+ genes) or a benzonitrile (nitrilase gene), and glutathione S-transferase in Przbila et al., Plant Cell 3:169 (1991), U.S. Pat. No. 4,810,648, and Hayes et al., Biochem. J. 285: 173 (1992).

Genes encoding enzymes detoxifying the herbicide or a mutant glutamine synthase enzyme that is resistant to inhibition, e.g., in U.S. patent application Ser. No. 11/760,602. Or a detoxifying enzyme is an enzyme encoding a phosphinothricin acetyltransferase (such as the bar or pat protein from *Streptomyces* species). Phosphinothricin acetyltransferases are for example described in U.S. Pat. Nos. 5,561,236; 5,648,477; 5,646,024; 5,273,894; 5,637,489; 5,276,268; 5,739,082; 5,908,810 and 7,112,665.

Hydroxyphenylpyruvatedioxygenases (HPPD) inhibitors, i.e., naturally occurring HPPD resistant enzymes, or genes encoding a mutated or chimeric HPPD enzyme as described in WO 96/38567, WO 99/24585, and WO 99/24586, WO 2009/144079, WO 2002/046387, or U.S. Pat. No. 6,768,044.

4. Examples of Genes Involved in Abiotic Stress Tolerance:

Transgene capable of reducing the expression and/or the activity of poly(ADP-ribose) polymerase (PARP) gene in the plant cells or plants as described in WO 00/04173 or, WO/2006/045633.

Transgenes capable of reducing the expression and/or the activity of the PARG encoding genes of the plants or plants cells, as described e.g., in WO 2004/090140.

Transgenes coding for a plant-functional enzyme of the nicotineamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphorybosyltransferase as described e.g., in EP 04077624.7, WO 2006/133827, PCT/EP07/002,433, EP 1999263, or WO 2007/107326.

Enzymes involved in carbohydrate biosynthesis include those described in e.g., EP 0571427, WO 95/04826, EP 0719338, WO 96/15248, WO 96/19581, WO 96/27674, WO 97/11188, WO 97/26362, WO 97/32985, WO 97/42328, WO 97/44472, WO 97/45545, WO 98/27212, WO 98/40503, WO99/58688, WO 99/58690, WO 99/58654, WO 00/08184, WO 00/08185, WO 00/08175, WO 00/28052, WO 00/77229, WO 01/12782, WO 01/12826, WO 02/101059, WO 03/071860, WO 2004/056999, WO 2005/030942, WO 2005/030941, WO 2005/095632, WO 2005/095617, WO 2005/095619, WO 2005/095618, WO 2005/123927, WO 2006/018319, WO 2006/103107, WO 2006/108702, WO 2007/009823, WO 00/22140, WO 2006/063862, WO 2006/072603, WO 02/034923, EP 06090134.5, EP 06090228.5, EP 06090227.7, EP 07090007.1, EP 07090009.7, WO 01/14569, WO 02/79410, WO 03/33540, WO 2004/078983, WO 01/19975, WO 95/26407, WO 96/34968, WO 98/20145, WO 99/12950, WO 99/66050, WO 99/53072, U.S. Pat. No. 6,734,341, WO 00/11192, WO 98/22604, WO 98/32326, WO 01/98509, WO 01/98509, WO 2005/002359, U.S. Pat. Nos. 5,824,790, 6,013,861, WO 94/04693, WO 94/09144, WO 94/11520, WO 95/35026 or WO 97/20936 or enzymes involved in the production of polyfructose, especially of the inulin and levan-type, as disclosed in EP 0663956, WO 96/01904, WO 96/21023, WO 98/39460, and WO 99/24593, the production of alpha-1,4-glucans as disclosed in WO 95/31553, US 2002031826, U.S. Pat. Nos. 6,284,479, 5,712,107, WO 97/47806, WO 97/47807, WO 97/47808 and WO 00/14249, the production of alpha-1,6 branched alpha-1,4-glucans, as disclosed in WO 00/73422, the production of alternan, as disclosed in e.g., WO 00/47727, WO 00/73422, EP 06077301.7, U.S. Pat. No. 5,908,975 and EP 0728213, the production of hyaluronan, as for example disclosed in WO 2006/032538, WO 2007/039314, WO 2007/039315, WO 2007/039316, JP 2006304779, and WO 2005/012529.

Genes that improve drought resistance. For example, WO 2013122472 discloses that the absence or reduced level of functional Ubiquitin Protein Ligase protein (UPL) protein, more specifically, UPL3, leads to a decreased need for water or improved resistance to drought of said plant. Other examples of transgenic plants with increased drought tolerance are disclosed in, for example, US 2009/0144850, US 2007/0266453, and WO 2002/083911. US2009/0144850 describes a plant displaying a drought tolerance phenotype due to altered expression of a DR02 nucleic acid. US 2007/0266453 describes a plant displaying a drought tolerance phenotype due to altered expression of a DR03 nucleic acid and WO 2002/083911 describes a plant having an increased tolerance to drought stress due to a reduced activity of an ABC transporter which is expressed in guard cells. Another example is the work by Kasuga and coauthors (1999), who describe that overexpression of cDNA encoding DREB1 A in transgenic plants activated the expression of many stress tolerance genes under normal growing conditions and resulted in improved tolerance to drought, salt loading, and freezing. However, the expression of DREB1A also resulted in severe growth retardation under normal growing conditions (Kasuga (1999) Nat Biotechnol 17(3) 287-291).

In further particular embodiments, crop plants can be improved by influencing specific plant traits, for example, by developing pesticide-resistant plants, improving disease resistance in plants, improving plant insect and nematode resistance, improving plant resistance against parasitic weeds, improving plant drought tolerance, improving plant nutritional value, improving plant stress tolerance, avoiding self-pollination, plant forage digestibility biomass, grain yield etc. A few specific non-limiting examples are provided herein below.

In addition to targeted mutation of single genes, C2c1 CRISPR complexes can be designed to allow targeted mutation of multiple genes, deletion of chromosomal fragment, site-specific integration of transgene, site-directed mutagenesis in vivo, and precise gene replacement or allele swapping in plants. Therefore, the methods described herein have broad applications in gene discovery and validation, mutational and cisgenic breeding, and hybrid breeding. These applications facilitate the production of a new generation of genetically modified crops with various improved agronomic traits such as herbicide resistance, disease resistance, abiotic stress tolerance, high yield, and superior quality.

Use of C2c1 Gene to Create Male Sterile Plants

Hybrid plants typically have advantageous agronomic traits compared to inbred plants. However, for self-pollinating plants, the generation of hybrids can be challenging. In different plant types, genes have been identified which are important for plant fertility, more particularly male fertility. For instance, in maize, at least two genes have been identified which are important in fertility (Amitabh Mohanty International Conference on New Plant Breeding Molecular Technologies Technology Development And Regulation, Oct. 9-10, 2014, Jaipur, India; Svitashev et al. Plant Physiol. 2015 October; 169(2):931-45; Djukanovic et al. Plant J. 2013 December; 76(5):888-99). The methods provided herein can be used to target genes required for male fertility so as to generate male sterile plants which can easily be crossed to generate hybrids. In particular embodiments, the CRISPR-C2c1 system provided herein is used for targeted mutagenesis of the cytochrome P450-like gene (MS26) or the meganuclease gene (MS45) thereby conferring male sterility to the maize plant. Maize plants which are as such genetically altered can be used in hybrid breeding programs.

Increasing the Fertility Stage in Plants

In particular embodiments, the methods provided herein are used to prolong the fertility stage of a plant such as of a rice plant. For instance, a rice fertility stage gene such as Ehd3 can be targeted in order to generate a mutation in the gene and plantlets can be selected for a prolonged regeneration plant fertility stage (as described in CN 104004782).

Use of C2c1 to Generate Genetic Variation in a Crop of Interest

The availability of wild germplasm and genetic variations in crop plants is the key to crop improvement programs, but the available diversity in germplasms from crop plants is limited. The present invention envisages methods for generating a diversity of genetic variations in a germplasm of interest. In this application of the CRISPR-C2c1 system, a library of guide RNAs targeting different locations in the plant genome is provided and is introduced into plant cells together with the C2c1 effector protein. In this way a collection of genome-scale point mutations and gene knockouts can be generated. In particular embodiments, the methods comprise generating a plant part or plant from the cells so obtained and screening the cells for a trait of interest. The target genes can include both coding and non-coding regions. In particular embodiments, the trait is stress tolerant and the method is a method for the generation of stress-tolerant crop varieties.

Use of C2c1 to Affect Fruit-Ripening

Ripening is a normal phase in the maturation process of fruits and vegetables. Only a few days after it starts it renders a fruit or vegetable inedible. This process brings significant losses to both farmers and consumers. In particular embodiments, the methods of the present invention are used to reduce ethylene production. This is ensured by ensuring one or more of the following: a. Suppression of ACC synthase gene expression. ACC (1-aminocyclopropane-1-carboxylic acid) synthase is the enzyme responsible for the conversion of S-adenosylmethionine (SAM) to ACC; the second to the last step in ethylene biosynthesis. Enzyme expression is hindered when an antisense (“mirror-image”) or truncated copy of the synthase gene is inserted into the plant's genome. b. Insertion of the ACC deaminase gene. The gene coding for the enzyme is obtained from *Pseudomonas chlororaphis*, a common nonpathogenic soil bacterium. It converts ACC to a different compound thereby reducing the amount of ACC available for ethylene production. c. Insertion of the SAM hydrolase gene. This approach is similar to ACC deaminase wherein ethylene production is hindered when the amount of its precursor metabolite is reduced; in this case SAM is converted to homoserine. The gene coding for the enzyme is obtained from *E. coli* T3 bacteriophage. And d. Suppression of ACC oxidase gene expression. ACC oxidase is the enzyme which catalyzes the oxidation of ACC to ethylene, the last step in the ethylene biosynthetic pathway. Using the methods described herein, down regulation of the ACC oxidase gene results in the suppression of ethylene production, thereby delaying fruit ripening. In particular embodiments, additionally or alternatively to the modifications described above, the methods described herein are used to modify ethylene receptors, so as to interfere with ethylene signals obtained by the fruit. In particular embodiments, expression of the ETR1 gene, encoding an ethylene binding protein is modified, more particularly suppressed. In particular embodiments, additionally or alternatively to the modifications described above, the methods described herein are used to modify expression of the gene encoding Polygalacturonase (PG), which is the enzyme responsible for the breakdown of pectin, the substance that maintains the integrity of plant cell walls. Pectin breakdown occurs at the start of the ripening process resulting in the softening of the fruit. Accordingly, in particular embodiments, the methods described herein are used to introduce a mutation in the PG gene or to suppress activation of the PG gene in order to reduce the amount of PG enzyme produced thereby delaying pectin degradation.

Thus, in particular embodiments, the methods comprise the use of the CRISPR-C2c1 system to ensure one or more modifications of the genome of a plant cell, such as described above, and regenerating a plant therefrom. In particular embodiments, the plant is a tomato plant.

Increasing Storage Life of Plants

In particular embodiments, the methods of the present invention are used to modify genes involved in the production of compounds which affect storage life of the plant or plant part. More particularly, the modification is in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods provided herein are used to reduce or inhibit expression of the vacuolar invertase gene (VInv), which encodes a protein that breaks down sucrose to glucose and fructose (Clasen et al. DOI: 10.1111/pbi.12370).

The Use of the CRISPR-C2c1 System to Ensure a Value Added Trait

In particular embodiments the CRISPR-C2c1 system is used to produce nutritionally improved agricultural crops. In particular embodiments, the methods provided herein are adapted to generate "functional foods", i.e., a modified food or food ingredient that may provide a health benefit beyond the traditional nutrients it contains and or "nutraceutical", i.e., substances that may be considered a food or part of a food and provides health benefits, including the prevention and treatment of disease. In particular embodiments, the nutraceutical is useful in the prevention and/or treatment of one or more of cancer, diabetes, cardiovascular disease, and hypertension.

Examples of nutritionally improved crops include (Newell-McGloughlin, Plant Physiology, July 2008, Vol. 147, pp. 939-953):

modified protein quality, content and/or amino acid composition, such as have been described for Bahiagrass (Luciani et al. 2005, Florida Genetics Conference Poster), Canola (Roesler et al., 1997, Plant Physiol 113 75-81), Maize (Cromwell et al, 1967, 1969 J Anim Sci 26 1325-1331, O'Quin et al. 2000 J Anim Sci 78 2144-2149, Yang et al. 2002, Transgenic Res 11 11-20, Young et al. 2004, Plant J 38 910-922), Potato (Yu J and Ao, 1997 Acta Bot Sin 39 329-334; Chakraborty et al. 2000, Proc Natl Acad Sci USA 97 3724-3729; Li et al. 2001) Chin Sci Bull 46 482-484, Rice (Katsube et al. 1999, Plant Physiol 120 1063-1074), Soybean (Dinkins et al. 2001, Rapp 2002, In Vitro Cell Dev Biol Plant 37 742-747), Sweet Potato (Egnin and Prakash 1997, In Vitro Cell Dev Biol 33 52A).

Essential amino acid content, such as has been described for Canola (Falco et al. 1995, Bio/Technology 13 577-582), Lupin (White et al. 2001, J Sci Food Agric 81 147-154), Maize (Lai and Messing, 2002, Agbios 2008 GM crop database (Mar. 11, 2008)), Potato (Zeh et al. 2001, Plant Physiol 127 792-802), Sorghum (Zhao et al. 2003, Kluwer Academic Publishers, Dordrecht, The Netherlands, pp 413-416), Soybean (Falco et al. 1995 Bio/Technology 13 577-582; Galili et al. 2002 Crit Rev Plant Sci 21 167-204).

Oils and Fatty acids such as for Canola (Dehesh et al. (1996) Plant J 9 167-172 [PubMed]; Del Vecchio (1996) INFORM International News on Fats, Oils and Related Materials 7 230-243; Roesler et al. (1997) Plant Physiol 113 75-81 [PMC free article][PubMed]; Froman and Ursin (2002, 2003) Abstracts of Papers of the American Chemical Society 223 U35; James et al. (2003) Am J Clin Nutr 77 1140-1145 [PubMed]; Agbios (2008, above); coton (Chapman et al. (2001). J Am Oil Chem Soc 78 941-947; Liu et al. (2002) J Am Coll Nutr 21 205S-211S [PubMed]; O'Neill (2007) Australian Life Scientist.biotechnews.com.au/index-.php/id; 866694817;fp;4;fpid;2 (Jun. 17, 2008), Linseed (Abbadi et al., 2004, Plant Cell 16: 2734-2748), Maize (Young et al., 2004, Plant J 38 910-922), oil palm (Jalani et al. 1997, J Am Oil Chem Soc 74 1451-1455; Parveez, 2003, AgBiotechNet 113 1-8), Rice (Anai et al., 2003, Plant Cell Rep 21 988-992), Soybean (Reddy and Thomas, 1996, Nat Biotechnol 14 639-642; Kinney and Kwolton, 1998, Blackie Academic and Professional, London, pp 193-213), Sunflower (Arcadia, Biosciences 2008).

Carbohydrates, such as Fructans described for Chicory (Smeekens (1997) Trends Plant Sci 2 286-287, Sprenger et al. (1997) FEBS Lett 400 355-358, Sevenier et al. (1998) Nat Biotechnol 16 843-846), Maize (Caimi et al. (1996) Plant Physiol 110 355-363), Potato (Hellwege et al., 1997 Plant J 12 1057-1065), Sugar Beet (Smeekens et al. 1997, above), Inulin, such as described for Potato (Hellewege et al. 2000, Proc Natl Acad Sci USA 97 8699-8704), Starch, such as described for Rice (Schwall et al. (2000) Nat Biotechnol 18 551-554, Chiang et al. (2005) Mol Breed 15 125-143).

Vitamins and carotenoids, such as described for Canola (Shintani and DellaPenna (1998) Science 282 2098-2100), Maize (Rocheford et al. (2002). J Am Coll Nutr 21 191S-198S, Cahoon et al. (2003) Nat Biotechnol 21 1082-1087, Chen et al. (2003) Proc Natl Acad Sci USA 100 3525-3530), Mustardseed (Shewmaker et al. (1999) Plant J 20 401-412, Potato (Ducreux et al., 2005, J Exp Bot 56 81-89), Rice (Ye et al. (2000) Science 287 303-305, Strawberry (Agius et al. (2003), Nat Biotechnol 21 177-181), Tomato (Rosati et al. (2000) Plant J 24 413-419, Fraser et al. (2001) J Sci Food Agric 81 822-827, Mehta et al. (2002) Nat Biotechnol 20 613-618, Diaz de la Garza et al. (2004) Proc Natl Acad Sci USA 101 13720-13725, Enfissi et al. (2005) Plant Biotechnol J 3 17-27, DellaPenna (2007) Proc Natl Acad Sci USA 104 3675-3676.

Functional secondary metabolites, such as described for Apple (stilbenes, Szankowski et al. (2003) Plant Cell Rep 22: 141-149), Alfalfa (resveratrol, Hipskind and Paiva (2000) Mol Plant Microbe Interact 13 551-562), Kiwi (resveratrol, Kobayashi et al. (2000) Plant Cell Rep 19 904-910), Maize and Soybean (flavonoids, Yu et al. (2000) Plant Physiol 124 781-794), Potato (anthocyanin and alkaloid glycoside, Lukaszewicz et al. (2004) J Agric Food Chem 52 1526-1533), Rice (flavonoids & resveratrol, Stark-Lorenzen et al. (1997) Plant Cell Rep 16 668-673, Shin et al. (2006) Plant Biotechnol J 4 303-315), Tomato (+resveratrol, chlorogenic acid, flavonoids, stilbene; Rosati et al. (2000) above, Muir et al. (2001) Nature 19 470-474, Niggeweg et al. (2004) Nat Biotechnol 22 746-754, Giovinazzo et al. (2005) Plant Biotechnol J 3 57-69), wheat (caffeic and ferulic acids, resveratrol; United Press International (2002)); and Mineral availabilities such as described for Alfalfa (phytase, Austin-Phillips et al. (1999) molecularfarming-.com/nonmedical.html), Lettuse (iron, Goto et al. (2000) Theor Appl Genet 100 658-664), Rice (iron, Lucca et al. (2002) J Am Coll Nutr 21 184S-190S), Maize, Soybean and wheate (phytase, Drakakaki et al. (2005) Plant Mol Biol 59 869-880, Denbow et al. (1998) Poult Sci 77 878-881, Brinch-Pedersen et al. (2000) Mol Breed 6 195-206).

In particular embodiments, the value-added trait is related to the envisaged health benefits of the compounds present in the plant. For instance, in particular embodiments, the value-added crop is obtained by applying the methods of the invention to ensure the modification of or induce/increase the synthesis of one or more of the following compounds:

Carotenoids, such as α-Carotene present in carrots which Neutralizes free radicals that may cause damage to cells or β-Carotene present in various fruits and vegetables which neutralizes free radicals.

Lutein present in green vegetables which contributes to maintenance of healthy vision.

Lycopene present in tomato and tomato products, which is believed to reduce the risk of prostate cancer.

Zeaxanthin, present in citrus and maize, which contributes to mainteance of healthy vision.

Dietary fiber such as insoluble fiber present in wheat bran which may reduce the risk of breast and/or colon cancer and β-Glucan present in oat, soluble fiber present in Psylium and whole cereal grains which may reduce the risk of cardiovascular disease (CVD).

Fatty acids, such as ω-3 fatty acids which may reduce the risk of CVD and improve mental and visual functions, conjugated linoleic acid, which may improve body composition, may decrease risk of certain cancers and GLA which may reduce inflammation risk of cancer and CVD, may improve body composition.

Flavonoids such as Hydroxycinnamates, present in wheat which have Antioxidant-like activities, may reduce risk of degenerative diseases, flavonols, catechins and tannins present in fruits and vegetables which neutralize free radicals and may reduce risk of cancer.

Glucosinolates, indoles, isothiocyanates, such as Sulforaphane, present in Cruciferous vegetables (broccoli, kale), horseradish, which neutralize free radicals, may reduce risk of cancer.

Phenolics, such as stilbenes present in grapes, which may reduce risk of degenerative diseases, heart disease, and cancer, may have longevity effect. Caffeic acid and ferulic acid present in vegetables and citrus, which have antioxidant-like activities, may reduce risk of degenerative diseases, heart disease, and eye disease. And epicatechin present in cacao, which has antioxidant-like activities, may reduce risk of degenerative diseases and heart disease.

Plant stanols/sterols present in maize, soy, wheat and wooden oils which may reduce risk of coronary heart disease by lowering blood cholesterol levels.

Fructans, inulins, and fructo-oligosaccharides present in Jerusalem artichoke, shallot, and onion powder, which may improve gastrointestinal health.

Saponins present in soybean, which may lower LDL cholesterol.

Soybean protein present in soybean which may reduce risk of heart disease.

Phytoestrogens, such as isoflavones present in soybean, which may reduce menopause symptoms, such as hot flashes, and may reduce osteoporosis and CVD. Lignans present in flax, rye and vegetables, which may protect against heart disease and some cancers, and may lower LDL cholesterol and total cholesterol.

Sulfides and thiols, such as diallyl sulphide, present in onion, garlic, olives, leeks and scallions and Allyl methyl trisulfide, such as dithiolthiones, present in cruciferous vegetables, which may lower LDL cholesterol and helps to maintain a healthy immune system.

Tannins, such as proanthocyanidins, present in cranberry and cocoa, which may improve urinary tract health, may reduce risk of CVD and high blood pressure.

In addition, the methods of the present invention also envisage modifying protein/starch functionality, shelf life, taste/aesthetics, fiber quality, and allergen, antinutrient, and toxin reduction traits.

Accordingly, the invention encompasses methods for producing plants with nutritional added value, said methods comprising introducing into a plant cell a gene encoding an enzyme involved in the production of a component of added nutritional value using the CRISPR-C2c1 system as described herein and regenerating a plant from said plant cell, said plant characterized in an increase expression of said component of added nutritional value. In particular embodiments, the CRISPR-C2c1 system is used to modify the endogenous synthesis of these compounds indirectly, e.g., by modifying one or more transcription factors that controls the metabolism of this compound. Methods for introducing a gene of interest into a plant cell and/or modifying an endogenous gene using the CRISPR-C2c1 system are described herein above.

Some specific examples of modifications in plants that have been modified to confer value-added traits are plants with modified fatty acid metabolism, for example, by transforming a plant with an antisense gene of stearyl-ACP desaturase to increase stearic acid content of the plant. See Knultzon et al., Proc. Natl. Acad. Sci. U.S.A. 89:2624 (1992). Another example involves decreasing phytate content, for example by cloning and then reintroducing DNA associated with the single allele which may be responsible for maize mutants characterized by low levels of phytic acid. See Raboy et al, Maydica 35:383 (1990).

Similarly, expression of the maize (*Zea mays*) Tfs C1 and R, which regulate the production of flavonoids in maize aleurone layers under the control of a strong promoter, resulted in a high accumulation rate of anthocyanins in *Arabidopsis* (*Arabidopsis thaliana*), presumably by activating the entire pathway (Bruce et al., 2000, Plant Cell 12:65-80). DellaPenna (Welsch et al., 2007 Annu Rev Plant Biol 57: 711-738) found that Tf RAP2.2 and its interacting partner SINAT2 increased carotenogenesis in *Arabidopsis* leaves. Expressing the Tf Dof1 induced the up-regulation of genes encoding enzymes for carbon skeleton production, a marked increase of amino acid content, and a reduction of the Glc level in transgenic *Arabidopsis* (Yanagisawa, 2004 Plant Cell Physiol 45: 386-391), and the DOF Tf AtDof1.1 (OBP2) up-regulated all steps in the glucosinolate biosynthetic pathway in *Arabidopsis* (Skirycz et al., 2006 Plant J 47: 10-24).

Reducing Allergen in Plants

In particular embodiments, the methods provided herein are used to generate plants with a reduced level of allergens, making them safer for the consumer. In particular embodiments, the methods comprise modifying expression of one or more genes responsible for the production of plant allergens. For instance, in particular embodiments, the methods comprise delivering the CRISPR-C2c1 system to down-regulating expression of a Lol p5 gene in a plant cell, such as a ryegrass plant cell and regenerating a plant therefrom so as to reduce allergenicity of the pollen of said plant (Bhalla et al. 1999, Proc. Natl. Acad. Sci. USA Vol. 96: 11676-11680). In particular embodiments, the CRISPR-C2c1 system introduces one or more staggered double strand breaks (DSBs) to the Lol p5 gene. In other particular embodiments, the CRISPR-C2c1 system comprises a catalytically inactivated C2c1 protein associated with a functional domain that modifies the Lol p5 gene. In a particular embodiment, the CRISPR-C2c1 system introduces a single mutation to the Lol p5 gene. In another particular embodiment, the CRISPR-C2c1 system introduces a single nucleotide modification to the transcript of the Lol p5 gene.

Peanut allergies and allergies to legumes generally are a real and serious health concern. The C2c1 effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

Screening Methods for Endogenous Genes of Interest

The methods provided herein further allow the identification of genes of value encoding enzymes involved in the production of a component of added nutritional value or generally genes affecting agronomic traits of interest, across species, phyla, and plant kingdom. By selectively targeting e.g., genes encoding enzymes of metabolic pathways in plants using the CRISPR-C2c1 system as described herein, the genes responsible for certain nutritional aspects of a plant can be identified. Similarly, by selectively targeting genes which may affect a desirable agronomic trait, the relevant genes can be identified. Accordingly, the present invention encompasses screening methods for genes encoding enzymes involved in the production of compounds with a particular nutritional value and/or agronomic traits.

Use of CRISPR-C2c1 System in Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the CRISPR-C2c1 system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant, the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). More particularly, the methods disclosed herein are used to generate mutations in homologs to CaslL to reduce polysaccharide acetylation.

Modifying Yeast for Biofuel Production

In particular embodiments, the C2c1 enzyme provided herein is used for bioethanol production by recombinant micro-organisms. For instance, C2c1 can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the C2c1 CRISPR complex is used to introduce foreign genes required for biofuel production into micro-organisms and/or to modify endogenous genes which may interfere with the biofuel synthesis. More particularly, the methods involve introducing into a micro-organism, such as a yeast, one or more nucleotide sequence encoding enzymes involved in the conversion of pyruvate to ethanol or another product of interest. In particular embodiments, the methods ensure the introduction of one or more enzymes which allows the micro-organism to degrade cellulose, such as a cellulase. In yet further embodiments, the C2c1 CRISPR complex is used to modify endogenous metabolic pathways which compete with the biofuel production pathway.

Accordingly, in more particular embodiments, the methods described herein are used to modify a micro-organism as follows:

- to introduce at least one heterologous nucleic acid or increase expression of at least one endogenous nucleic acid encoding a plant cell wall degrading enzyme, such that said micro-organism is capable of expressing said nucleic acid and of producing and secreting said plant cell wall degrading enzyme;
- to introduce at least one heterologous nucleic acid or increase expression of at least one endogenous nucleic acid encoding an enzyme that converts pyruvate to acetaldehyde optionally combined with at least one heterologous nucleic acid encoding an enzyme that converts acetaldehyde to ethanol such that said host cell is capable of expressing said nucleic acid; and/or
- to modify at least one nucleic acid encoding for an enzyme in a metabolic pathway in said host cell, wherein said pathway produces a metabolite other than acetaldehyde from pyruvate or ethanol from acetaldehyde, and wherein said modification results in a reduced production of said metabolite, or to introduce at least one nucleic acid encoding for an inhibitor of said enzyme.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

According to particular embodiments of the invention, the CRISPR-C2c1 system is used to generate lipid-rich diatoms which are useful in biofuel production.

In particular embodiments, it is envisaged to specifically modify genes that are related to the biomass production produced by plants. In particular embodiments, the CRISPR-C2c1 system is used to generate high biomass plants by targeting the teosine branched (tb) genes or homologues thereof. In certain embodiments, the CRISPR-C2c1 system introduces one or more staggered double strand breaks (DSBs) to the tb genes. In a particular embodiment, the CRISPR-C2c1 system introduces a single mutation to the tb gene. In another particular embodiment, the CRISPR-C2c1 system introduces a single nucleotide modification to the transcript of the tb gene. In certain particular embodiments, the CRISPR-C2c1 system comprises a catalytically inactivated C2c1 protein associated to a functional domain such as an adenosine or cytidine deaminase (e.g., via fusion protein or suitable linkers) to introduce a single nucleotide mutation to the tb gene or homologues thereof. In a particular embodiment, the CRISPR-C2c1 system is used to generate high biomass switchgrass plants by targeting the tb1a and tb1b genes and introducing a single nucleotide mutation. See Liu et. al, Plant Biotechnology Journal (doi:10.1111/pbi.12778).

In particular embodiments, it is envisaged to specifically modify genes that are involved in the modification of the quantity of lipids and/or the quality of the lipids produced by the algal cell. Examples of genes encoding enzymes involved in the pathways of fatty acid synthesis can encode proteins having for instance acetyl-CoA carboxylase, fatty acid synthase, 3-ketoacyl_acyl-carrier protein synthase III, glycerol-3-phospate deshydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid:diacylglycerol acyltransferase, phoshatidate phosphatase, fatty acid thioesterase such as palmitoyi protein thioesterase, or malic enzyme activities. In further embodiments, it is envisaged to generate diatoms that have increased lipid accumulation. This can be achieved by targeting genes that decrease lipid catabolisation. Of particular interest for use in the methods of the present invention are genes involved in the activation of both triacylglycerol and free fatty acids, as well as genes directly involved in β-oxidation of fatty acids, such as acyl-CoA synthetase, 3-ketoacyl-CoA thiolase, acyl-CoA oxidase activity and phosphoglucomutase. The CRISPR-C2c1 system and methods described herein can be used to specifically activate such genes in diatoms as to increase their lipid content.

Organisms such as microalgae are widely used for synthetic biology. Stovicek et al. (Metab. Eng. Comm., 2015; 2:13) describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2μ-based vector locations. The authors also showed that gene disruption efficiency could be improved by optimization of the levels of Cas9 and gRNA expression. Hlavovi et al. (Biotechnol. Adv. 2015) discusses development of species or strains of microalgae using techniques such as CRISPR to target nuclear and chloroplast genes for insertional mutagenesis and screening. The methods of Stovicek and Hlavovi may be applied to the C2c1 effector protein system of the present invention. With respect to the CRISPR-C2c1 system, in some embodiments, the CRISPR-C2c1 system may recognize a PAM sequence of 5' TTN 3' or 5' ATTN 3', wherein N is any nucleotide. In some embodiments, the CRISPR-C2c1 system introduces one or more staggered double strand breaks (DSBs) to the target gene. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the Lol p5 gene. In a particular embodiment, the CRISPR-C2c1 system introduces a single mutation. In another particular embodiment, the CRISPR-C2c1 system introduces a single nucleotide modification to the transcript.

U.S. Pat. No. 8,945,839 describes a method for engineering Micro-Algae (*Chlamydomonas reinhardtii* cells species) using Cas9. Using similar tools, the methods of the CRISPR-C2c1 system described herein can be applied on *Chlamydomonas* species and other algae. In particular embodiments, C2c1 and guide RNA are introduced in algae expressed using a vector that expresses C2c1 under the control of a constitutive promoter such as Hsp70A-Rbc S2 or Beta2-tubulin. Guide RNA will be delivered using a vector containing T7 promoter. Alternatively, C2c1 mRNA and in vitro transcribed guide RNA can be delivered to algal cells. Electroporation protocol follows standard recommended protocol from the GeneArt *Chlamydomonas* Engineering kit. The methods of U.S. Pat. No. 8,945,839 may be applied to the C2c1 effector protein system of the present invention. With respect to the CRISPR-C2c1 system, in some embodiments, the CRISPR-C2c1 system may recognize a PAM sequence of 5' TTN 3' or 5' ATTN 3', wherein N is any nucleotide. In some embodiments, the CRISPR-C2c1 system introduces one or more staggered double strand breaks (DSBs) to the target gene. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

The Use of C2c1 in the Generation of Micro-Organisms Capable of Fatty Acid Production In particular embodiments, the methods of the invention are used for the generation of genetically engineered micro-organisms capable of the production of fatty esters, such as fatty acid methyl esters ("FAME") and fatty acid ethyl esters ("FAEE").

Typically, host cells can be engineered to produce fatty esters from a carbon source, such as an alcohol, present in the medium, by expression or overexpression of a gene encoding a thioesterase, a gene encoding an acyl-CoA synthase, and a gene encoding an ester synthase. Accordingly, the methods provided herein are used to modify a micro-organism so as to overexpress or introduce a thioesterase gene, a gene encoding an acyl-CoA synthase, and a gene encoding an ester synthase. In particular embodiments, the thioesterase gene is selected from tesA, 'tesA, tesB, fatB, fatB2, fatB3, fatA1, or fatA. In particular embodiments, the gene encoding an acyl-CoA synthase is selected from fadDJadK, BH3103, pfl-4354, EAV15023, fadD1, fadD2, RPC_4074, fadDD35, fadDD22, faa39, or an identified gene encoding an enzyme having the same properties. In particular embodiments, the gene encoding an ester synthase is a gene encoding a synthase/acyl-CoA:diacylglycerl acyltransferase from *Simmondsia chinensis, Acinetobacter* sp. ADP, *Alcanivorax borkumensis, Pseudomonas aeruginosa, Fundibacter jadensis, Arabidopsis thaliana*, or *Alkaligenes eutrophus*, or a variant thereof. Additionally or alternatively, the methods provided herein are used to decrease expression in said micro-organism of at least one of a gene encoding an acyl-CoA dehydrogenase, a gene encoding an outer membrane protein receptor, and a gene encoding a transcriptional regulator of fatty acid biosynthesis. In particular embodiments, one or more of these genes is inactivated, such as by introduction of a mutation. In particular embodiments, the gene encoding an acyl-CoA dehydrogenase is fadE. In particular embodiments, the gene encoding a transcriptional regulator of fatty acid biosynthesis encodes a DNA transcription repressor, for example, fabR.

Additionally or alternatively, said micro-organism is modified to reduce expression of at least one of a gene encoding a pyruvate formate lyase, a gene encoding a lactate dehydrogenase, or both. In particular embodiments, the gene encoding a pyruvate formate lyase is pflB. In particular embodiments, the gene encoding a lactate dehydrogenase is IdhA. In particular embodiments, one or more of these genes is inactivated, such as by introduction of a mutation therein. In some embodiments, the CRISPR-C2c1 system introduces one or more staggered double strand breaks (DSBs) with a 5'-overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

In particular embodiments, the micro-organism is selected from the genus *Escherichia, Bacillus, Lactobacillus, Rhodococcus, Synechococcus, Synechoystis, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia*, or *Streptomyces.*

The Use of C2c1 in the Generation of Micro-Organisms Capable of Organic Acid Production The methods provided herein are further used to engineer micro-organisms capable of organic acid production, more particularly from pentose or hexose sugars. In particular embodiments, the methods comprise introducing into a micro-organism an exogenous LDH gene. In particular embodiments, the organic acid production in said micro-organisms is additionally or alternatively increased by inactivating endogenous genes encoding proteins involved in an endogenous metabolic pathway which produces a metabolite other than the organic acid of interest and/or wherein the endogenous metabolic pathway consumes the organic acid. In particular embodiments, the modification ensures that the production of the metabolite other than the organic acid of interest is reduced. According to particular embodiments, the methods are used to introduce at least one engineered gene deletion and/or inactivation of an endogenous pathway in which the organic acid is consumed or a gene encoding a product involved in an endogenous pathway which produces a metabolite other than the organic acid of interest. In particular embodiments, the at least one engineered gene deletion or inactivation is in one or more genes encoding an enzyme selected from the group consisting of pyruvate decarboxylase (pdc), fumarate reductase, alcohol dehydrogenase (adh), acetaldehyde dehydrogenase, phosphoenolpyruvate carboxylase (ppc), D-lactate dehydrogenase (d-ldh), L-lactate dehydrogenase (l-ldh), lactate 2-monooxygenase. In further embodiments, the at least one engineered gene deletion and/or inactivation is in an endogenous gene encoding pyruvate decarboxylase (pdc).

In further embodiments, the micro-organism is engineered to produce lactic acid and the at least one engineered gene deletion and/or inactivation is in an endogenous gene encoding lactate dehydrogenase. Additionally or alternatively, the micro-organism comprises at least one engineered gene deletion or inactivation of an endogenous gene encoding a cytochrome-dependent lactate dehydrogenase, such as a cytochrome B2-dependent L-lactate dehydrogenase.

The Use of C2c1 in the Generation of Improved Xylose or Cellobiose Utilizing Yeasts Strains In particular embodiments, the CRISPR-C2c1 system may be applied to select improved xylose or cellobiose utilizing yeast strains. Error-prone PCR can be used to amplify one (or more) genes involved in the xylose utilization or cellobiose utilization pathways. Examples of genes involved in xylose utilization pathways and cellobiose utilization pathways may include, without limitation, those described in Ha, S. J., et al. (2011) Proc. Natl. Acad. Sci. USA 108(2):504-9 and Galazka, J. M., et al. (2010) Science 330(6000):84-6. Resulting libraries of double-stranded DNA molecules, each comprising a random mutation in such a selected gene, could be co-transformed with the components of the CRISPR-C2c1 system into a yeast strain (for instance S288C) and strains can be selected with enhanced xylose or cellobiose utilization capacity, as described in WO2015138855.

The Use of C2c1 in the Generation of Improved Yeasts Strains for Use in Isoprenoid Biosynthesis Tadas Jakočiūnas et al. described the successful application of a multiplex CRISPR/Cas9 system for genome engineering of up to 5 different genomic loci in one transformation step in baker's yeast *Saccharomyces cerevisiae* (Metabolic Engineering Volume 28, March 2015, Pages 213-222) resulting in strains with high mevalonate production, a key intermediate for the industrially important isoprenoid biosynthesis pathway. In particular embodiments, the CRISPR-C2c1 system may be applied in a multiplex genome engineering method as described herein for identifying additional high producing yeast strains for use in isoprenoid synthesis. With regard to the C2c1 protein, in some embodiments, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with 7-nt 5' overhang to the target gene. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

The Use of C2c1 in the Generation of Lactic Acid Producing Yeasts Strains

In another embodiment, successful application of a multiplex CRISPR-C2c1 system is encompassed. In analogy with Vratislav Stovicek et al. (Metabolic Engineering Communications, Volume 2, December 2015, Pages 13-22), improved lactic acid-producing strains can be designed and obtained in a single transformation event. In a particular embodiment, the CRISPR-C2c1 system is used for simultaneously inserting the heterologous lactate dehydrogenase gene and disruption of two endogenous genes PDC1 and PDC5 genes. With regard to the C2c1 protein, in some embodiments, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation to the PDC1 or PD5 gene. In another particular embodiment, the CRISPR-C2c1 system introduces a single nucleotide modification to the transcript of the PDC1 or PDC5 gene.

Further Applications of the CRISPR-C2c1 System in Plants

In particular embodiments, the CRISPR system, and preferably the CRISPR-C2c1 system described herein, can be used for visualization of genetic element dynamics. For example, CRISPR imaging can visualize either repetitive or non-repetitive genomic sequences, report telomere length change and telomere movements and monitor the dynamics of gene loci throughout the cell cycle (Chen et al., Cell, 2013). These methods may also be applied to plants.

Other applications of the CRISPR system, and preferably the CRISPR-C2c1 system described herein, is the targeted gene disruption positive-selection screening in vitro and in vivo (Malina et al., Genes and Development, 2013). These methods may also be applied to plants.

In particular embodiments, fusion of inactive C2c1 endonucleases with histone-modifying enzymes can introduce custom changes in the complex epigenome (Rusk et al., Nature Methods, 2014). These methods may also be applied to plants.

In particular embodiments, the CRISPR system, and preferably the CRISPR-C2c1 system described herein, can be used to purify a specific portion of the chromatin and identify the associated proteins, thus elucidating their regulatory roles in transcription (Waldrip et al., Epigenetics, 2014). These methods may also be applied to plants.

In particular embodiments, the present invention can be used as a therapy for virus removal in plant systems as it is able to cleave both viral DNA and RNA. Previous studies in human systems have demonstrated the success of utilizing CRISPR in targeting the single strand RNA virus, hepatitis C (A. Price, et al., Proc. Natl. Acad. Sci, 2015) as well as the double stranded DNA virus, hepatitis B (V. Ramanan, et al., Sci. Rep, 2015). These methods may also be adapted for using the CRISPR-C2c1 system in plants.

In particular embodiments, present invention could be used to alter genome complexity. In further particular embodiments, the CRISPR system, and preferably the CRISPR-C2c1 system described herein, can be used to disrupt or alter chromosome number and generate haploid plants, which only contain chromosomes from one parent. Such plants can be induced to undergo chromosome duplication and converted into diploid plants containing only homozygous alleles (Karimi-Ashtiyani et al., PNAS, 2015; Anton et al., Nucleus, 2014). These methods may also be applied to plants.

In particular embodiments, the CRISPR-C2c1 system described herein, can be used for self-cleavage. In these embodiments, the promotor of the C2c1 enzyme and gRNA can be a constitutive promotor and a second gRNA is introduced in the same transformation cassette, but controlled by an inducible promoter. This second gRNA can be designated to induce site-specific cleavage in the C2c1 gene in order to create a non-functional C2c1. In a further particular embodiment, the second gRNA induces cleavage on both ends of the transformation cassette, resulting in the removal of the cassette from the host genome. This system offers a controlled duration of cellular exposure to the Cas enzyme and further minimizes off-target editing. Furthermore, cleavage of both ends of a CRISPR/Cas cassette can be used to generate transgene-free T0 plants with bi-allelic mutations (as described for Cas9 e.g., Moore et al., Nucleic Acids Research, 2014; Schaeffer et al., Plant Science, 2015). The methods of Moore et al. may be applied to the CRISPR-C2c1 systems described herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR-Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR-Cas9-based targeted mutagenesis. The methods of Sugano et al. may be applied to the C2c1 effector protein system of the present invention.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The methods of Kabadi et al. may be applied to the C2c1 effector protein system of the present invention.

Ling et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation (guide RNA) module vector set, as a toolkit for multiplex genome editing in plants. The toolbox of Lin et al. may be applied to the C2c1 effector protein system of the present invention.

Protocols for targeted plant genome editing via CRISPR-C2c1 are also available based on those disclosed for the CRISPR-Cas9 system in volume 1284 of the series Methods in Molecular Biology pp 239-255 10 Feb. 2015. A detailed procedure to design, construct, and evaluate dual gRNAs for plant codon optimized Cas9 (pcoCas9) mediated genome editing using *Arabidopsis thaliana* and *Nicotiana benthamiana* protoplasts model cellular systems are described. Strategies to apply the CRISPR-Cas9 system to generating targeted genome modifications in whole plants are also discussed. The protocols described in the chapter may be applied to the C2c1 effector protein system of the present invention.

With respect to the C2c1 protein in the above-mentioned methods and protocols, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in T0 rice and T1*Arabidopsis* plants by simultaneous targeting of multiple (up to eight) members of a gene family, multiple genes in a biosynthetic pathway, or multiple sites in a single gene. The methods of Ma et al. may be applied to the C2c1 effector protein system of the present invention. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Lowder et al. (Plant Physiol. 2015 Aug. 21. pii: pp. 00636.2015) also developed a CRISPR-Cas9 toolbox enabling multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, C2c1 (WT, nickase or dC2c1) and gRNA(s) may be assembled into a T-DNA destination-vector of interest. The assembly method is based on both Golden Gate assembly and MultiSite Gateway recombination. Three modules are required for assembly. The first module is a C2c1 entry vector, which contains promoterless C2c1 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for C2c1 expression. The toolbox of Lowder et al. may be applied to the C2c1 effector protein system of the present invention. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Wang et al. (bioRxiv 051342; doi: doi.org/10.1101/051342; Epub. May 12, 2016) demonstrate editing of homoeologous copies of four genes affecting important agronomic traits in hexaploid wheat using a multiplexed gene editing construct with several gRNA-tRNA units under the control of a single promoter.

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the C2c1 effector protein system of the present invention. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula*×alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the C2c1 effector protein system of the present invention. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

In plants, pathogens are often host-specific. For example, *Fusarium oxysporum* f. sp. *lycopersici* causes tomato wilt but attacks only tomato, and *F. oxysporum* f. *dianthii Puccinia graminis* f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

The following table provides additional references and related fields for which the CRISPR-Cas complexes, modified effector proteins, systems, and methods of optimization may be used to improve bioproduction. In some embodiments, the CRISPR-Cas complex comprises a C2c1 protein or catalytic domain thereof complexed with a tracr RNA, a guide RNA comprising a guide sequence linked to a direct repeat, wherein the guide sequence hybridizes with the target sequence. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

| | | |
|---|---|---|
| Feb. 17, 2014 | PCT/US15/63434 (WO2016/099887) | Compositions and methods for efficient gene editing in *E. coli* using guide RNA/Cas endonuclease systems in combination with circular polynucleotide modification templates. |
| Aug. 13, 2014 | PCT/US15/41256 (WO2016/025131) | Genetic targeting in non-conventional yeast using an RNA-guided endonuclease. |
| Nov. 6, 2014 | PCT/US15/58760 (WO2016/073433) | Peptide-mediated delivery of RNA-guided endonuclease into cells. |
| Oct. 12, 2015 | PCT/US16/56404 (WO2017/066175) | Protected DNA templates for gene modification and increased homologous recombination in cells and methods of use. |
| Dec. 11, 2015 | PCT/US16/65070 (WO2017/100158) | Methods and compositions for enhanced nuclease-mediated genome modification and reduced off-target site effects. |
| Dec. 18, 2015 | PCT/US16/65537 (WO2017/105991) | Methods and compositions for T-RNA based guide RNA expression. |
| Dec. 18, 2015 | PCT/US16/66772 (WO2017/106414) | Methods and compositions for polymerase II (Pol-II) based guide RNA expression. |
| Dec. 16, 2014 | PCT/US15/65693 (WO2016/100272) | Fungal genome modification systems and methods of use. |
| Dec. 16, 2014 | PCT/US15/66195 (WO2016/100571) | Fungal genome modification systems and methods of use |
| Dec. 16, 2014 | PCT/US15/66192 (WO2016/100568) | Fungal genome modification systems and methods of use. |
| Dec. 16, 2014 | PCT/US15/66178 (WO2016/100562) | Use of a helper strain with silenced NHEJ to improve homologous integration of targeted DNA cassettes in *Trichoderma reesei*. |
| Jul. 28, 2015 | PCT/US16/44489 (WO2017/019867) | Genome editing systems and methods of use. |

Improved Plants and Yeast Cells

The present invention also provides plants and yeast cells obtainable and obtained by the methods provided herein. The improved plants obtained by the methods described herein may be useful in food or feed production through expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or over-express high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regen-eratable, and/or non-regeneratable.

In one embodiment, the method described in Soyk et al. (Nat Genet. 2017 January; 49(1):162-168), which used CRISPR-Cas9 mediated mutation targeting flowering repressor SP5G in tomatoes to produce early yield tomatoes may be modified for the CRISPR-Cas system as disclosed in this invention. In some embodiments, the CRISPR protein is a C2c1, and the system comprises: I. a CRISPR-Cas system RNA polynucleotide sequence, wherein the polynucleotide sequence comprises: (a) a guide RNA polynucleotide capable of hybridizing to a target sequence, and (b) a direct repeat RNA polynucleotide, and II. a polynucleotide sequence encoding the C2c1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence, and the poly-nucleotide sequence encoding a CRISPR protein is DNA or RNA. In some embodiments, the plant cell genome comprises T-rich PAMs. In particular embodiments, the PAM is 5'-TTN-3' or 5'-ATTN-3'. In a particular embodiment, the PAM is 5'-TTG-3'. In some embodiments, the CRISPR effector protein is a C2c1 protein. C2c1 creates double strand breaks at the distal end of PAM, in contrast to cleavage at the proximal end of PAM created by Cas9 (Jinek et al., 2012; Cong et al., 2013). It is proposed that Cpf1 mutated target sequences may be susceptible to repeated cleavage by a single gRNA, hence promoting Cpf1's application in HDR mediated genome editing (Front Plant Sci. 2016 Nov. 14; 7:1683). Cpf1 and C2c1 are both Type V CRISPR Cas proteins that share structure similarity. Like C2c1, Cpf1 creates staggered double strand breaks at the distal end of PAM (in contrast to Cas9, which creates blunt cut at the proximal end of PAM). Accordingly, in certain embodiments, the locus of interest is modified by the CRISPR-C2c1 complex via homology directed repair (HR or HDR). In certain embodiments, the locus of interest is modified by the CRISPR-C2c1 complex independent of HR. In certain embodiments, the locus of interest is modified by the CRISPR-C2c1 complex via non-homologous end joining (NHEJ).

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

Thus, the invention provides a plant, animal, or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants.

The methods for genome editing using the C2c1 system as described herein can be used to confer desired traits on essentially any plant, algae, fungus, yeast, etc. A wide variety of plants, algae, fungus, yeast, etc. and plant algae, fungus, yeast cell or tissue systems may be engineered for the desired physiological and agronomic characteristics described herein using the nucleic acid constructs of the present disclosure and the various transformation methods mentioned above.

In particular embodiments, the methods described herein are used to modify endogenous genes or to modify their expression without the permanent introduction into the genome of the plant, algae, fungus, yeast, etc. of any foreign gene, including those encoding CRISPR components, so as to avoid the presence of foreign DNA in the genome of the plant. This can be of interest as the regulatory requirements for non-transgenic plants are less rigorous. In some particular embodiments, the CRISPR-C2c1 system comprises a catalytically inactivated C2c1 protein associated with a functional domain that modifies the target gene. In a particular embodiment, the functional domain comprises a deaminase, preferably an adenosine deaminase. In another particular embodiment, the CRISPR-C2c1 system introduces a single nucleotide modification to the transcript.

The CRISPR systems provided herein can be used to introduce targeted double-strand or single-strand breaks and/or to introduce gene activator and or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

The methods described herein generally result in the generation of "improved plants, algae, fungi, yeast, etc." in that they have one or more desirable traits compared to the wildtype plant. In particular embodiments, the plants, algae, fungi, yeast, etc., cells or parts obtained are transgenic plants, comprising an exogenous DNA sequence incorporated into the genome of all or part of the cells. In particular embodiments, non-transgenic genetically modified plants, algae, fungi, yeast, etc., parts or cells are obtained, in that no exogenous DNA sequence is incorporated into the genome of any of the cells of the plant. In such embodiments, the improved plants, algae, fungi, yeast, etc. are non-transgenic. Where only the modification of an endogenous gene is ensured and no foreign genes are introduced or maintained in the plant, algae, fungi, yeast, etc. genome, the resulting genetically modified crops contain no foreign genes and can thus basically be considered non-transgenic. The different applications of the CRISPR-C2c1 system for plant, algae, fungi, yeast, etc. genome editing include, but are not limited to, introduction of one or more foreign genes to confer an agricultural trait of interest; editing of endogenous genes to confer an agricultural trait of interest; modulating of endogenous genes by the CRISPR-C2c1 system to confer an agricultural trait of interest. Because the C2c1 protein creates staggered double strand breaks (DSBs) at the target site, exogenous DNA sequence may be introduced, or knocked-in with or without homology directed repair (HR) (for example, via NHEJ). Exemplary genes conferring agronomic traits include, but are not limited to, genes that confer resistance to pests or diseases; genes involved in plant diseases, such as those listed in WO 2013046247; genes that confer resistance to herbicides, fungicides, or the like; genes involved in (abiotic) stress tolerance. Other aspects of the use of the CRISPR-Cas system include, but are not limited to, create (male) sterile plants; increasing the fertility stage in plants/algae etc.; generate genetic variation in a crop of interest; affect fruit-ripening; increasing storage life of plants/algae etc.; reducing allergen in plants/algae etc.; ensure a value added trait (e.g., nutritional improvement); Screening methods for endogenous genes of interest; biofuel, fatty acid, organic acid, etc. production.

C2c1 Effector Protein Complexes can be Used in Non-Animal Organisms, Such as Plants, Algae, Fungi, Yeasts, Etc.

The methods for genome editing using the C2c1 system as described herein can be used to confer desired traits on essentially any plant, algae, fungus, yeast, etc. A wide variety of plants, algae, fungus, yeast, etc. and plant algae, fungus, yeast cell or tissue systems may be engineered for the desired physiological and agronomic characteristics described herein using the nucleic acid constructs of the present disclosure and the various transformation methods mentioned above.

An anti-browning white button mushroom (*Aaricus bisporus*) strain was developed by introducing 1-14nt deletions into polyphenol oxidase gene with a CRISPR-Cas9 system comprising a guide RNA and a Cas9 protein, delivered to the mushroom cells via PEG transformation. See Yang et al. (news.psu.edu/story/432734/2016/10/19/academics/penn-state-developer-gene-edited-mushroom-wins-best-whats-new). The CRISPR-C2c1 system as described herein may be used with the method of Yang et al. With respect to the C2c1 protein, the CRISPR-C2c1 system recognizes a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In particular embodiments, the 5' overhang is 7 nt. In some embodiments, the CRISPR-C2c1 system introduces an exogenous template DNA sequence at the staggered DSB via HR or NHEJ. In preferred embodiments, the CRISPR-C2c1 system introduces an exogenous template DNA sequence at the staggered DSB via NHEJ. In some embodiments, the C2c1 effector protein comprises one or more mutations. In some embodiments, the C2c1 effector protein is a nickase. In some particular embodiments, the CRISPR-C2c1 system comprises a catalytically inactivated C2c1 protein associated with a functional domain that modifies the target locus of interest. In particular embodiments, the methods described herein are used to modify endogenous genes or to modify their expression without the permanent introduction into the genome of the plant, algae, fungus, yeast, etc. of any foreign gene, including those encoding CRISPR components, so as to avoid the presence of foreign DNA in the genome of the plant. This can be of interest as the regulatory requirements for non-transgenic plants are less rigorous.

The CRISPR systems provided herein can be used to introduce targeted double-strand or single-strand breaks and/or to introduce gene activator and or repressor systems and without being limitative, can be used for gene targeting, gene replacement, targeted mutagenesis, targeted deletions or insertions, targeted inversions and/or targeted translocations. By co-expression of multiple targeting RNAs directed to achieve multiple modifications in a single cell, multiplexed genome modification can be ensured. This technology can be used for high-precision engineering of plants with improved characteristics, including enhanced nutritional quality, increased resistance to diseases and resistance to biotic and abiotic stress, and increased production of commercially valuable plant products or heterologous compounds.

The methods described herein generally result in the generation of "improved plants, algae, fungi, yeast, etc." in that they have one or more desirable traits compared to the wildtype plant. In particular embodiments, the plants, algae, fungi, yeast, etc., cells or parts obtained are transgenic plants, comprising an exogenous DNA sequence incorporated into the genome of all or part of the cells. In particular embodiments, non-transgenic genetically modified plants, algae, fungi, yeast, etc., parts or cells are obtained, in that no exogenous DNA sequence is incorporated into the genome of any of the cells of the plant. In such embodiments, the improved plants, algae, fungi, yeast, etc. are non-transgenic. Where only the modification of an endogenous gene is ensured and no foreign genes are introduced or maintained in the plant, algae, fungi, yeast, etc. genome, the resulting genetically modified crops contain no foreign genes and can thus basically be considered non-transgenic. The different applications of the CRISPR-C2c1 system for plant, algae, fungi, yeast, etc. genome editing include, but are not limited to, introduction of one or more foreign genes to confer an agricultural trait of interest; editing of endogenous genes to confer an agricultural trait of interest; modulating of endogenous genes by the CRISPR-C2c1 system to confer an agricultural trait of interest. Exemplary genes conferring agronomic traits include, but are not limited to, genes that confer resistance to pests or diseases; genes involved in plant diseases, such as those listed in WO 2013046247; genes that confer resistance to herbicides, fungicides, or the like; genes involved in (abiotic) stress tolerance. Other aspects of the use of the CRISPR-Cas system include, but are not limited to, create (male) sterile plants; increasing the fertility stage in plants/algae etc.; generate genetic variation in a crop of interest; affect fruit-ripening; increasing storage life of plants/algae etc.; reducing allergen in plants/algae etc.; ensure a value added trait (e.g., nutritional improvement); Screening methods for endogenous genes of interest; biofuel, fatty acid, organic acid, etc. production.

Applications in Non-Human Animals

In an aspect, the invention provides a non-human eukaryotic organism, preferably a multicellular eukaryotic organism, comprising a eukaryotic host cell according to any of the described embodiments. In other aspects, the invention provides a eukaryotic organism, preferably a multicellular eukaryotic organism, comprising a eukaryotic host cell according to any of the described embodiments. The organism in some embodiments of these aspects may be an animal, for example a mammal. Also, the organism may be an arthropod such as an insect. The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20; 111(20):7260-5), utilized a reporter-guided transcription activator-like effector nuclease (TALEN) system to generate targeted modifications of recombination activating gene (RAG) 2 in somatic cells at high efficiency, including some that affected both alleles. The C2c1 effector protein may be applied to a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

The methods of Lee et al., (Proc Natl Acad Sci USA. 2014 May 20; 111(20):7260-5), may be applied to the present invention analogously as follows. Mutated pigs are produced by targeted modification of RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 is screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell is placed in the perivitelline. The reconstructed embryos are then electrically porated to fuse the donor cell with the oocyte and then chemically activated. The activated embryos are incubated in Porcine Zygote Medium 3 (PZM3) with 0.5 μM Scriptaid (S7817; Sigma-Aldrich) for 14-16 h. Embryos are then washed to remove the Scriptaid and cultured in PZM3 until they were transferred into the oviducts of surrogate pigs. The C2c1 effector protein may be applied to a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

The present invention is used to create a platform to model a disease or disorder of an animal, in some embodiments a mammal, in some embodiments a human. In certain embodiments, such models and platforms are rodent based, in non-limiting examples rat or mouse. Such models and platforms can take advantage of distinctions among and comparisons between inbred rodent strains. In certain embodiments, such models and platforms are primate, horse, cattle, sheep, goat, swine, dog, cat or bird-based, for example to directly model diseases and disorders of such animals or to create modified and/or improved lines of such animals. Advantageously, in certain embodiments, an animal based platform or model is created to mimic a human disease or disorder. For example, the similarities of swine to humans make swine an ideal platform for modeling human diseases. Compared to rodent models, development of swine models has been costly and time intensive. On the other hand, swine and other animals are much more similar to humans genetically, anatomically, physiologically, and pathophysiologically. The present invention provides a high efficiency platform for targeted gene and genome editing, gene and genome modification, and gene and genome regulation to be used in such animal platforms and models. Though ethical standards block development of human models and, in many cases, models based on non-human primates, the present invention is used with in vitro systems, including but not limited to, cell culture systems, three dimensional models and systems, and organoids to mimic, model, and investigate genetics, anatomy, physiology and pathophysiology of structures, organs, and systems of humans. The platforms and models provide manipulation of single or multiple targets.

In certain embodiments, the present invention is applicable to disease models like that of Schomberg et al. (FASEB Journal, April 2016; 30(1):Suppl 571.1). To model the inherited disease neurofibromatosis type 1 (NF-1), Schomberg used CRISPR-Cas9 to introduce mutations in the swine neurofibromin 1 gene by cytosolic microinjection of CRISPR/Cas9 components into swine embryos. CRISPR guide RNAs (gRNA) were created for regions targeting sites both upstream and downstream of an exon within the gene for targeted cleavage by Cas9 and repair was mediated by a specific single-stranded oligodeoxynucleotide (ssODN) template to introduce a 2500 bp deletion. The CRISPR-Cas system was also used to engineer swine with specific NF-1 mutations or clusters of mutations, and further can be used to engineer mutations that are specific to, or representative of, a given human individual. The invention is similarly used to develop animal models, including, but not limited to, swine models of human multigenic diseases. According to the invention, multiple genetic loci in one gene or in multiple genes are simultaneously targeted using multiplexed guides and optionally one or multiple templates.

The present invention is also applicable to modifying SNPs of other animals, such as cows. Tan et al. (Proc Natl Acad Sci USA. 2013 Oct. 8; 110(41): 16526-16531) expanded the livestock gene editing toolbox to include transcription activator-like (TAL) effector nuclease (TALEN)- and clustered regularly interspaced short palindromic repeats (CRISPR)/Cas9-stimulated homology-directed repair (HDR) using plasmid, rAAV, and oligonucleotide templates. Gene specific gRNA sequences were cloned into the Church lab gRNA vector (Addgene ID: 41824) according to their methods (Mali P, et al. (2013) RNA-Guided Human Genome Engineering via Cas9. Science 339(6121):823-826). The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI-AgeI fragment from the hCas9 plasmid (encompassing the hCas9 cDNA) into the RCIScript plasmid. The C2c1 effector protein may be applied to a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7-nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification at the SNP position of the transcript.

Heo et al. (Stem Cells Dev. 2015 Feb. 1; 24(3):393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generated induced pluripotent stem cells (iPSCs) from bovine somatic fibroblasts by the ectopic expression of yamanaka factors and GSK3β and MEK inhibitor (2i) treatment. Heo et al. observed that these bovine iPSCs are highly similar to naive pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos. The C2c1 effector protein may be applied to a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the NANOG locus. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the NANOG locus. In a particular embodiment, the CRISPR-C2c1 system introduces a single mutation. In another particular embodiment, the CRISPR-C2c1 system introduces a single nucleotide modification to the transcript corresponding to the NANOG locus.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle Genome Coordination Program (animalgenome.org/cattle/maps/db.html). Thus, the present invention maybe applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting the first exon of the dog Myostatin (MSTN) gene (a negative regulator of skeletal muscle mass). First, the efficiency of the sgRNA was validated, using cotransfection of the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and auto-transplantation of the zygotes into the oviduct of the same female dog. The knock-out puppies displayed an obvious muscular phenotype on thighs compared with its wild-type littermate sister. This can also be performed using the CRISPR-C2c1 systems provided herein. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Livestock

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e., a CD163 knock out.

Accordingly, in some embodiments, porcine alveolar macrophages may be targeted by the CRISPR protein. In some embodiments, porcine CD163 may be targeted by the CRISPR protein. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock breeding or modelling purposes (i.e., a porcine model). Semen comprising the gene knock out is also provided.

CD163 is a member of the scavenger receptor cysteine-rich (SRCR) superfamily. Based on in vitro studies, SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, H1N2, H2N1, H3N1, H3N2, and H2N3, as well as pneumonia, meningitis and oedema mentioned above.

The C2c1 effector protein may be applied to similar systems as described above. With respect to the C2c1 protein, the CRISPR-C2c1 system may recognize a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang to the CD163 locus. In particular embodiments, the 5' overhang is 7 nt. In some embodiments, the CRISPR-C2c1 system introduces an exogenous template DNA sequence at the staggered DSB via HR or NHEJ. In some particular embodiments, the CRISPR-C2c1 system comprises a catalytically inactivated C2c1 protein associated with a functional domain that modifies CD163. In a particular embodiment, the CRISPR-C2c1 system introduces a single mutation. In another particular embodiment, the CRISPR-C2c1 system introduces a single nucleotide modification to the CD163 transcript without modifying the genome of the livestock.

Uncoupling protein 1 (UCP1) is localized on the inner mitochondrial membrane and generates heat by uncoupling ATP synthesis from proton transit across the inner membrane. UCP1 is a key element of nonshivering thermogenesis and is most likely important in the regulation of body adiposity. Pigs (Artiodactyl family Suidae) lacking a functional UCP1 gene suffer from poor thermoregulation and are susceptibile to cold. Pigs' fat accumulation may also be linked to their lack of UCP1, and thus influences the efficiency of pig production. Zheng et al. reported application of a CRISPR/Cas9-mediated, homologous recombination (HR)-independent approach to efficiently insert mouse adiponectin-UCP1 into the porcine endogenous UCP1 locus.

The UCP1 knock-in (KI) pigs showed an improved ability to maintain body temperature during acute cold exposure, but they did not have alterations in physical activity levels or total daily energy expenditure (DEE). Ectopic UCP1 expression in white adipose tissue (WAT) dramatically decreased fat deposition by 4.89% ($P<0.01$), consequently increasing carcass lean percentage (CLP; $P<0.05$). Mechanism studies indicated that the loss of fat upon UCP1 activation in WAT was linked to elevated lipolysis. The CRISPR-C2c1 system disclosed in this invention may be applied to similar systems as described in Zheng et al. With respect to the C2c1 protein, the CRISPR-C2c1 system may recognize a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In certain embodiments, the 5' overhang is 7 nt. In particular embodiments, the CRISPR-C2c1 system may be used to introduce an exogenous template DNA sequence at the staggered DSB at the UCP1 locus via HR or HR independent mechanism, such as NHEJ.

Niu et al. (DOI: 10.1126/science.aan4187) reported porcine endogenous retroviruses (PERVs) inactivated pig livestock via somatic cell nuclear transfer with a CRISPR-Cas9 system. Xenotransplantation is a promising strategy to alleviate the shortage of organs for human transplantation. One main risk of cross-species transmission of porcine endogenous retroviruses (PERVs) is that PERVs are harmless to pigs but may be lethal to human. Niu et al. described inactivating PERV activity in an immortalized pig cell line with CRISPR-Cas9 and generating PERV-inactivated pigs via somatic nuclear transfer. Wu et al. (Scientific Reports 7, Article number: 10487 (2017) doi:10.1038/s41598-017-08596-5) reported efficient disabling of pancreatogenesis in pig embryos via zygotic co-delivery of Cas9 mRNA and dual sgRNAs targeting the PDX1 gene, which when combined with chimeric-competent human pluripotent stem cells may serve as a suitable platform for the xeno-generation of human tissues and organs in pigs. Zhou et al. (Hum Mutat 37:110-118, 2016) reported gene-modified pigs harboring precise orthologous human mutation (Sox 10 c.A325>T) via CRISPR-Cas9 induced HDR in pig zygotes using single strand DNA as template with an efficiency as high as 80%. The CRISPR-C2c1 system as disclosed herein may be applied to similar systems as described in Niu et al., Wu et al. and Zhou et al to produce swine livestock. In certain embodiments, the CRISPR-C2c1 system modifies a virus resistance related gene. In some embodiments, the CRISPR-C2c1 system modifies a disease related gene. In certain embodiments, the CRISPR-C2c1 system modifies a livestock biomass related gene. In certain embodiments, the CRISPR-C2c1 system modifies a livestock trait related gene. In particular embodiments, the trait related gene is involved in the regulation of adiposity. In some embodiments, the trait related gene is involved in regulation of expression of specific proteins, wherein such proteins are related to food allergy. In a particular embodiment, the CRISPR-C2c1 system modifies the UCP1 locus. With respect to the C2c1 protein, the CRISPR-C2c1 system recognizes a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In particular embodiments, the 5' overhang is 7 nt. In some embodiments, the CRISPR-C2c1 system introduces an exogenous template DNA sequence at the staggered DSB via HR or NHEJ. In some particular embodiments, the CRISPR-C2c1 system comprises a catalytically inactivated C2c1 protein associated with a functional domain that modifies the target locus of interest. In a particular embodiment, the CRISPR-C2c1 system introduces a single mutation. In another particular embodiment, the CRISPR-C2c1 system introduces a single nucleotide modification to the transcript of the target locus of interest without modifying the genome of the livestock.

Gao et al. (Genome Biology 201718:13, doi:10.1186/s13059-016-1144-4) reported tuberculosis (TB) resistant cattle livestock using a single CRISPR-Cas9 nickase (Cas9n) to induce gene insertion at a selected locus in cattle. The main binding sites of a catalytically inactive Cas9 protein was determined in bovine fetal fibroblast cells (BFFs) with chromatin immunoprecipitation sequencing (ChIP-seq). Subsequently, a CRISPR-Cas9n-induced single-strand break was used to stimulate the insertion of the natural resistance-associated macrophage protein-1 (NRAMP1) gene. The TB resistant livestock was obtained via somatic cell nuclear transfer. Carlson et al. (Nat Biotechnol. 2016 May 6; 34(5):479-81. doi: 10.1038/nbt.3560) reported hornless dairy cattle livestock using transcription activator-like effector nucleases (TALENs) inserted into an allele of the POLLED gene into the genome of bovine embryo fibroblasts followed by somatic cell nuclear transfer to clone the genetically engineered cell lines and implanted the embryos into recipient cow. The CRISPR-C2c1 system as disclosed herein may be applied to similar systems as described in Gao et al. and Carlson et al. in producing cattle livestock. In certain embodiments, the CRISPR-C2c1 system modifies a virus resistance related gene. In some embodiments, the CRISPR-C2c1 system modifies a disease related gene. In certain embodiments, the CRISPR-C2c1 system modifies a livestock biomass related gene. In certain embodiments, the CRISPR-C2c1 system modifies a livestock trait related gene. In some embodiments, the trait related gene is involved in regulation of expression of specific proteins, wherein such proteins are related to food allergy. In particular embodiments, the trait related gene is involved in the regulation of adiposity. With respect to the C2c1 protein, the CRISPR-C2c1 system recognizes a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In particular embodiments, the 5' overhang is 7 nt. In some embodiments, the CRISPR-C2c1 system introduces an exogenous template DNA sequence at the staggered DSB via HR or NHEJ. In some embodiments, the C2c1 effector protein comprises one or more mutations. In some embodiments, the C2c1 effector protein is a nickase. In some particular embodiments, the CRISPR-C2c1 system comprises a catalytically inactivated C2c1 protein associated with a functional domain that modifies the target locus of interest. In a particular embodiment, the CRISPR-C2c1 system introduces a single mutation. In another particular embodiment, the CRISPR-C2c1 system introduces a single nucleotide modification to the transcript of the target locus of interest without modifying the genome of the livestock.

Two chicken genes ovalbumin (OVA) and ovomucoid (OVM) have been shown as related to egg white allergy. Gene disruption of OVA and OVM has the potential to produce low allergenicity in eggs, thereby reducing immune responses in individuals sensitive to items such as egg white-containing food products and vaccines. Oishi et al. (Scientific Reports 6, Article number: 23980 (2016) doi: 10.1038/srep23980) reported CRISPR/Cas9-mediated gene targeting in chickens. Two egg white genes, ovalbumin and ovomucoid, were efficiently (>90%) mutagenized in cultured chicken primordial germ cells (PGCs) by transfection of circular plasmids encoding Cas9, a single guide RNA, and a gene encoding drug resistance, followed by transient antibiotic selection. CRISPR-induced mutant-ovomucoid PGCs were transplanted into recipient chicken embryos and three germline chimeric roosters (G0) were established. All of the roosters had donor-derived mutant-ovomucoid spermatozoa, and the two with a high transmission rate of donor-derived gametes produced heterozygous mutant ovomucoid chickens as about half of their donor-derived offspring in the next generation (G1). Ovomucoid homozygous mutant offspring (G2) were generated by crossing the G1 mutant chickens.

Traditional methods of avian transgenesis involve retroviral infection of blastoderms or the ex vivo manipulation of primordial germ cells (PGCs) followed by injection of the cells back into a recipient embryo. Unlike in mammalian systems, avian embryonic PGCs undergo a migration through the vasculature on their path to the gonad where they become the sperm or ova producing cells. Tyack et al. (Transgenic Res. 2013 December; 22(6):1257-64. doi: 10.1007/s11248-013-9727-2) described a method of transforming PGC using Lipofectamine 2000 complexed with Tol2 transposon and transposase plasmids to stably transform PGCs in vivo generating transgenic offspring that express a reporter gene carried in the transposon. The CRISPR-C2c1 system as disclosed herein may be applied to similar systems as described in Oishi et al. in producing poultry livestock. In certain embodiments, the CRISPR-C2c1 system modifies a virus resistance related gene. In some embodiments, the CRISPR-C2c1 system modifies a disease related gene. In certain embodiments, the CRISPR-C2c1 system modifies a livestock biomass related gene. In certain embodiments, the CRISPR-C2c1 system modifies a livestock trait related gene. In some embodiments, the trait related gene is involved in regulation of expression of specific proteins, wherein such proteins are related to food allergy. In particular embodiments, the trait related gene is involved in the regulation of adiposity. With respect to the C2c1 protein, the CRISPR-C2c1 system recognizes a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In particular embodiments, the 5' overhang is 7 nt. In some embodiments, the CRISPR-C2c1 system introduces an exogenous template DNA sequence at the staggered DSB via HR or NHEJ. In some embodiments, the C2c1 effector protein comprises one or more mutations. In some embodiments, the C2c1 effector protein is a nickase. In some particular embodiments, the CRISPR-C2c1 system comprises a catalytically inactivated C2c1 protein associated with a functional domain that modifies the target locus of interest. In a particular embodiment, the CRISPR-C2c1 system introduces a single mutation. In another particular embodiment, the CRISPR-C2c1 system introduces a single nucleotide modification to the transcript of the target locus of interest without modifying the genome of the livestock.

Animal Models

The present invention provides a CRISPR-Cas system that may be used to develop animal models and cell models, in vivo, ex vivo and in vitro.

Niu et al. (Cell. 2014 Feb. 13; 156(4):836-43. doi: 10.1016/j.cell.2014.01.027) developed a monkey model that may serve as an important model species for studying human diseases and developing therapeutic strategies, yet the application of monkeys in biomedical researches has been significantly hindered by the difficulties in producing animals genetically modified at the desired target sites by applying the CRISPR/Cas9 system. The system enabled simultaneous disruption of two target genes (Ppar-γ and Rag1) in one step, and no off-target mutagenesis was detected by comprehensive analysis.

Wang et al. (Cell. 2013; 153(4):910-8) described producing an embryonic stem cell (ESC) transfection model with high efficiency for producing single (95%) or double mutant (70-80%) mice using direct injection of Cas9 mRNA and sgRNAs into fertilized zygotes. Various mouse models in mice zygote cells were described in Yen et al, Dev Biol. 2014; 393(1):3-9, Aida et al. Biol. 2015; 16(1):87, Inui et al., Sci Rep. 2014; 4:5396, Yang et al. Cell. 2013; 154(6):1370-9. Transplantation disease models involving ex vivo modification of stem cells provide an alternative to creating germline mutations, for example, with sgRNAs targeting p53 in Eμ-Myc lymphomas. See Heckl et al, Nat Biotechnol. 2014; 32(9):941-946, Chen et al. Cell. 2015; 160(6):1246-1260.

In one aspect, the present invention provides a treatment for tumors of the central nerve system, particularly induced by neurofibromatosis type 1 (NF1) neurogenetic conditions. Individuals with NF1 are born with a germline mutation in the NF1 gene, but may develop numerous distinct neurological problems, ranging from autism and attention deficit to brain and peripheral nerve sheath tumors. The present invention may be used to develop a patient-specific disease model and to study induced pluripotent stem cell (iPSC)-derived disease relevant cells in an isogenic background. Embryonic stem cell (ESC)-like cells, also known as induced pluripotent stem cell or iPSC, can be generated from skin or blood cells in adult patients. Recent research efforts have started to develop culture protocols that differentiate iPSCs into a variety of cell types in the central and peripheral nervous system (CNS and PNS), which are affected in NF1 patients. The CRISPR C2c1 system of this invention may be used to genetically edit the specific disease genes either by repairing the existing mutant genes or creating new mutations. In order to position at the forefront of NF1 research, it will be important for the Gilbert Family Neurofibromatosis Institute (GFNI) at the Children's National Medical Center to explore these recent exciting research developments, to systematically develop patient-specific human NF1 disease models, and to provide a tool for drug screening and evaluation on the individual NF patients.

In one aspect, the present invention provides a method of developing an inducible disease model.

Platt et al. (Cell. 2014; 159(2):440-55.) developed a Cre-dependent CAGs-LSL-Cas9 knock-in transgene, while 'all-in-one' doxycycline (dox)-inducible constructs were generated to provide both sgRNAs and Cas9 in the germline of the animal. The Cre-dependent model allows simple incorporation of CRISPR-mediated targeting into existing Cre-driven systems and provides robust and widespread Cas9 expression downstream of the strong CAGs promoter. The dox-inducible model enables targeting in either individual or multiple tissues, is not restricted by the ability to delivery exogenous sgRNAs, and provides a means to extinguish Cas9 expression following gene modification. Both approaches show extremely high efficiency of single or multiplexed gene modification in multiple tissues, and recapitulate the phenotypic consequences seen in traditional genetic knockouts. Each is amenable to the delivery of sgRNAs exogenously or through the germline of the animal, although importantly, the stable integration of Cas9 in the genome avoids the complication of packaging a large Cas9 cDNA into size restricted viral cassettes.

Creating a single-nucleotide polymorphism (SNP) animal model of human disease by CRISPR/Cas9 genome editing is now routine in rodent. These models lead to functional insights into the human genetics and allow development of potential new therapies. For example, a human GWAS identified a potential pathological SNP (rs1039084 A>G) in the STXBP5 gene, regulator of platelet secretion in humans. This mutation was then reproduced by CRISPR in the mouse with the nearly same thrombosis phenotype allowing to confirm the causality of this SNP in human (Zhu et al. Arterioscler Thromb Vasc Biol. 2017; 37:264-270). Likewise, whole-genome sequencing was used to perform a GWAS in a population-based biobank from Estonia. A number of potential causal variants and underlying mechanisms were identified. One of them is a regulatory element that is necessary for basophil production, it acts specifically during this process to regulate expression of the transcription factor CEBPA. This enhancer was perturbed by CRISPR/Cas9 in hematopoietic stem and progenitor cells demonstrating that it specifically regulates CEBPA expression during basophil differentiation (Guo et al. Proc Natl Acad Sci. 2016; 114:E327-E336. doi: 10.1073/pnas.1619052114).

The CRISPR-C2c1 system as disclosed herein may be used with methods described in the perturbation and disruption systems as described in Zhu et al., Niu et al., and Wang et al., etc. In some embodiments, the animal model comprises non-human eukaryote cells. In some embodiments, the animal model comprises non-human mammal cells. In some embodiments, the animal model comprises primate cells. In certain embodiments, the animal model comprises fish, zebra fish, ape, chimpanzee, macaque, mouse, rabbit, rat, canine, bovine, ovine, goat or pig cells. With respect to the C2c1 protein, the CRISPR-C2c1 system recognizes a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In particular embodiments, the 5' overhang is 7 nt. In some embodiments, the CRISPR- C2c1 system introduces an exogenous template DNA sequence at the staggered DSB via HR or NHEJ. In preferred embodiments, the CRISPR-C2c1 system introduces an exogenous template DNA sequence at the staggered DSB via NHEJ. In some embodiments, the C2c1 effector protein comprises one or more mutations. In some embodiments, the C2c1 effector protein is a nickase. In some particular embodiments, the CRISPR-C2c1 system comprises a catalytically inactivated C2c1 protein associated with a functional domain that modifies the target locus of interest. In a particular embodiment, the CRISPR-C2c1 system introduces a single mutation. In another particular embodiment, the CRISPR-C2c1 system introduces a single nucleotide modification to the transcript of the target locus of interest without modifying the genome of the livestock.

Therapeutic Applications

As will be apparent, it is envisaged that the present system can be used to target any polynucleotide sequence of interest. The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy.

Treating Pathogens, Like Bacterial, Fungal and Parasitic Pathogens

The present invention may also be applied to treat bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

Jiang et al. ("RNA-guided editing of bacterial genomes using CRISPR-Cas systems," Nature Biotechnology vol. 31, p. 233-9, March 2013) used a CRISPR-Cas9 system to mutate or kill *S. pneumoniae* and *E. coli*. The work, which introduced precise mutations into the genomes, relied on dual-RNA:Cas9-directed cleavage at the targeted genomic site to kill unmutated cells and circumvented the need for selectable markers or counter-selection systems. CRISPR systems have been used to reverse antibiotic resistance and eliminate the transfer of resistance between strains. Bickard et al. showed that Cas9, reprogrammed to target virulence genes, kills virulent, but not avirulent, *S. aureus*. Reprogramming the nuclease to target antibiotic resistance genes destroyed staphylococcal plasmids that harbor antibiotic resistance genes and immunized against the spread of plasmid-borne resistance genes. (see, Bikard et al., "Exploiting CRISPR-Cas nucleases to produce sequence-specific antimicrobials," Nature Biotechnology vol. 32, 1146-1150, doi: 10.1038/nbt.3043, published online 5 Oct. 2014.) Bikard showed that CRISPR-Cas9 antimicrobials function in vivo to kill *S. aureus* in a mouse skin colonization model. Similarly, Yosef et al used a CRISPR system to target genes encoding enzymes that confer resistance to β-lactam antibiotics (see Yousef et al., "Temperate and lytic bacteriophages programmed to sensitize and kill antibiotic-resistant bacteria," Proc. Natl. Acad. Sci. USA, vol. 112, p. 7267-7272, doi: 10.1073/pnas.1500107112 published online May 18, 2015).

CRISPR systems can be used to edit genomes of parasites that are resistant to other genetic approaches. For example, a CRISPR-Cas9 system was shown to introduce double-stranded breaks into the *Plasmodium yoelii* genome (see, Zhang et al., "Efficient Editing of Malaria Parasite Genome Using the CRISPR/Cas9 System," mBio. vol. 5, e01414-14, July-August 2014). Ghorbal et al. ("Genome editing in the human malaria parasite *Plasmodium falciparum* using the CRISPR-Cas9 system," Nature Biotechnology, vol. 32, p. 819-821, doi: 10.1038/nbt.2925, published online Jun. 1, 2014) modified the sequences of two genes, orc1 and kelch13, which have putative roles in gene silencing and emerging resistance to artemisinin, respectively. Parasites that were altered at the appropriate sites were recovered with very high efficiency, despite there being no direct selection for the modification, indicating that neutral or even deleterious mutations can be generated using this system. CRISPR-Cas9 is also used to modify the genomes of other pathogenic parasites, including *Toxoplasma gondii* (see Shen et al., "Efficient gene disruption in diverse strains of *Toxoplasma gondii* using CRISPR/CAS9," mBio vol. 5:e01114-14, 2014; and Sidik et al., "Efficient Genome Engineering of *Toxoplasma gondii* Using CRISPR/Cas9," PLoS One vol. 9, e100450, doi: 10.1371/journal.pone.0100450, published online Jun. 27, 2014).

Vyas et al. ("A *Candida albicans* CRISPR system permits genetic engineering of essential genes and gene families," Science Advances, vol. 1, e1500248, DOI: 10.1126/sciadv.1500248, Apr. 3, 2015) employed a CRISPR system to overcome long-standing obstacles to genetic engineering in *C. albicans* and efficiently mutate in a single experiment both copies of several different genes. In an organism where several mechanisms contribute to drug resistance, Vyas produced homozygous double mutants that no longer displayed the hyper-resistance to fluconazole or cycloheximide displayed by the parental clinical isolate Can90. Vyas also obtained homozygous loss-of-function mutations in essential genes of *C. albicans* by creating conditional alleles. Null alleles of DCR1, which is required for ribosomal RNA processing, are lethal at low temperature but viable at high temperature. Vyas used a repair template that introduced a nonsense mutation and isolated dcr1/dcr1 mutants that failed to grow at 16° C.

The CRISPR system of the present invention for use in *P. falciparum* by disrupting chromosomal loci.

Ghorbal et al. ("Genome editing in the human malaria parasite *Plasmodium falciparum* using the CRISPR-Cas9 system", Nature Biotechnology, 32, 819-821 (2014), DOI: 10.1038/nbt.2925, Jun. 1, 2014) employed a CRISPR system to introduce specific gene knockouts and single-nucleotide substitutions in the malaria genome. To adapt the CRISPR-Cas9 system to *P. falciparum*, Ghorbal et al. generated expression vectors for the control of plasmodial regulatory elements in the pUF1-Cas9 episome that also carries the drug-selectable marker ydhodh, which gives resistance to DSM1, a *P. falciparum* dihydroorotate dehydrogenase (PfDHODH) inhibitor and for transcription of the sgRNA, used *P. falciparum* U6 small nuclear (sn)RNA regulatory elements placing the guide RNA and the donor DNA template for homologous recombination repair on the same plasmid, pL7. See also, Zhang C. et al. ("Efficient editing of malaria parasite genome using the CRISPR/Cas9 system", MBio, 2014 Jul. 1; 5(4):E01414-14, doi: 10.1128/MbIO.01414-14) and Wagner et al. ("Efficient CRISPR-Cas9-mediated genome editing in *Plasmodium falciparum*, Nature Methods 11, 915-918 (2014), DOI: 10.1038/nmeth.3063).

In one aspect, the present invention provides a method of disrupting chromosome loci in organisms with A/T rich genomes such as *P. falciparum*. In some embodiments, the CRISPR system of the present invention comprises a CRISPR-C2c1 system, wherein the C2c1 protein creates a 7-nt staggered cut at the target site and wherein the PAM sequence is a T-rich sequence (Gardner et al., Nature. 2002; 419:531-534). A person with ordinary skill in the art may use the methods as described in Jiang et al., Bikard et al., Yosef et al., Vyas et al., Ghober et al., Zhang et al. and Wagner et al. with the CRISPR-C2c1 system as disclosed herein to introduce sequence disruption in A/T rich genomes.

In certain embodiments, the locus of interest is modified by the CRISPR-C2c1 complex by inserting, or "knocking-in" a template DNA sequence. In particular embodiments, the DNA insert is designed to integrate into the genome in the proper orientation. In preferred embodiments, the locus of interest is modified by the CRISPR-C2c1 system in non-dividing cells, where genome editing via homology-directed repair (HDR) mechanisms are especially challenging (Chan et al., Nucleic acids research. 2011; 39:5955-5966). Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic L02 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage.

Treating Pathogens, Like Viral Pathogens Such as HIV

Cas-mediated genome editing might be used to introduce protective mutations in somatic tissues to combat nongenetic or complex diseases. For example, NHEJ-mediated inactivation of the CCR5 receptor in lymphocytes (Lombardo et al., Nat Biotechnol. 2007 November; 25(11):1298-306) may be a viable strategy for circumventing HIV infection, whereas deletion of PCSK9 (Cohen et al., Nat Genet. 2005 February; 37(2):161-5) orangiopoietin (Musunuru et al., N Engl J Med. 2010 Dec. 2; 363(23):2220-7) may provide therapeutic effects against statin-resistant hypercholesterolemia or hyperlipidemia. Although these targets may be also addressed using siRNA-mediated protein knockdown, a unique advantage of NHEJ-mediated gene inactivation is the ability to achieve permanent therapeutic benefit without the need for continuing treatment. As with all gene therapies, it will of course be important to establish that each proposed therapeutic use has a favorable benefit-risk ratio.

Hydrodynamic delivery of plasmid DNA encoding Cas9 and guide RNA along with a repair template into the liver of an adult mouse model of tyrosinemia was shown to be able to correct the mutant Fah gene and rescue expression of the wild-type Fah protein in ~1 out of 250 cells (Nat Biotechnol. 2014 June; 32(6):551-3). In addition, clinical trials successfully used ZF nucleases to combat HIV infection by ex vivo knockout of the CCR5 receptor. In all patients, HIV DNA levels decreased, and in one out of four patients, HIV RNA became undetectable (Tebas et al., N Engl J Med. 2014 Mar. 6; 370(10):901-10). Both of these results demonstrate the promise of programmable nucleases as a new therapeutic platform. The C2c1 effector protein may be applied to a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention. A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.). The C2c1 effector protein may be applied to a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

With the knowledge in the art and the teachings in this disclosure, the skilled person can correct HSCs as to immunodeficiency condition such as HIV/AIDS comprising contacting an HSC with a CRISPR-C2c1 system that targets and knocks out CCR5. A guide RNA (and advantageously a dual guide approach, e.g., a pair of different guide RNAs; for instance, guide RNAs targeting of two clinically relevant genes, B2M and CCR5, in primary human CD4+ T cells and CD34+ hematopoietic stem and progenitor cells (HSPCs)) that targets and knocks out CCR5-and-C2c1 protein containing particle is contacted with HSCs. The so contacted cells can be administered; and optionally treated/expanded; cf. Cartier. See also Kiem, "Hematopoietic stem cell-based gene therapy for HIV disease," Cell Stem Cell. Feb. 3, 2012; 10(2): 137-147; incorporated herein by reference along with the documents it cites; Mandal et al, "Efficient Ablation of Genes in Human Hematopoietic Stem and Effector Cells using CRISPR/Cas9," Cell Stem Cell, Volume 15, Issue 5, p 643-652, 6 Nov. 2014; incorporated herein by reference along with the documents it cites. Mention is also made of Ebina, "CRISPR/Cas9 system to suppress HIV-1 expression by editing HIV-1 integrated proviral DNA" SCIENTIFIC REPORTS |3: 2510| DOI: 10.1038/srep02510, incorporated herein by reference along with the documents it cites, as another means for combatting HIV/AIDS using a CRISPR-C2c1 system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

The rationale for genome editing for HIV treatment originates from the observation that individuals homozygous for loss of function mutations in CCR5, a cellular co-receptor for the virus, are highly resistant to infection and otherwise healthy, suggesting that mimicking this mutation with genome editing could be a safe and effective therapeutic strategy [Liu, R., et al. Cell 86, 367-377 (1996)]. This idea was clinically validated when an HIV infected patient was given an allogeneic bone marrow transplant from a donor homozygous for a loss of function CCR5 mutation, resulting in undetectable levels of HIV and restoration of normal CD4 T-cell counts [Hutter, G., et al. The New England journal of medicine 360, 692-698 (2009)]. Although bone marrow transplantation is not a realistic treatment strategy for most HIV patients, due to cost and potential graft vs. host disease, HIV therapies that convert a patient's own T-cells into CCR5 are desirable.

Early studies using ZFNs and NHEJ to knockout CCR5 in humanized mouse models of HIV showed that transplantation of CCR5 edited CD4 T cells improved viral load and CD4 T-cell counts [Perez, E. E., et al. Nature biotechnology 26, 808-816 (2008)]. Importantly, these models also showed that HIV infection resulted in selection for CCR5 null cells, suggesting that editing confers a fitness advantage and potentially allowing a small number of edited cells to create a therapeutic effect.

As a result of this and other promising preclinical studies, genome editing therapy that knocks out CCR5 in patient T cells has now been tested in humans [Holt, N., et al. Nature biotechnology 28, 839-847 (2010); Li, L., et al. Molecular therapy: the journal of the American Society of Gene Therapy 21, 1259-1269 (2013)]. In a recent phase I clinical trial, CD4+ T cells from patients with HIV were removed, edited with ZFNs designed to knockout the CCR5 gene, and autologously transplanted back into patients [Tebas, P., et al. The New England journal of medicine 370, 901-910 (2014)].

In another study (Mandal et al., Cell Stem Cell, Volume 15, Issue 5, p 643-652, 6 Nov. 2014), CRISPR-Cas9 has targeted two clinically relevant genes, B2M and CCR5, in human CD4+ T cells and CD34+ hematopoietic stem and progenitor cells (HSPCs). The use of single RNA guides led to highly efficient mutagenesis in HSPCs but not in T cells. A dual guide approach improved gene deletion efficacy in both cell types. HSPCs that had undergone genome editing with CRISPR-Cas9 retained multilineage potential. Predicted on- and off-target mutations were examined via target capture sequencing in HSPCs and low levels of off-target mutagenesis were observed at only one site. These results demonstrate that CRISPR-Cas9 can efficiently ablate genes in HSPCs with minimal off-target mutagenesis, which have broad applicability for hematopoietic cell-based therapy.

Wang et al. (PLoS One. 2014 Dec. 26; 9(12):e115987. doi: 10.1371/journal.pone.0115987) silenced CCR5 via CRISPR associated protein 9 (Cas9) and single guided RNAs (guide RNAs) with lentiviral vectors expressing Cas9 and CCR5 guide RNAs. Wang et al. showed that a single round transduction of lentiviral vectors expressing Cas9 and CCR5 guide RNAs into HIV-1 susceptible human CD4+ cells yields high frequencies of CCR5 gene disruption. CCR5 gene-disrupted cells are not only resistant to R5-tropic HIV-1, including transmitted/founder (T/F) HIV-1 isolates, but also have selective advantage over CCR5 gene-undisrupted cells during R5-tropic HIV-1 infection. Genome mutations at potential off-target sites that are highly homologous to these CCR5 guide RNAs in stably transduced cells even at 84 days post transduction were not detected by a T7 endonuclease I assay.

Fine et al. (Sci Rep. 2015 Jul. 1; 5:10777. doi: 10.1038/srep10777) identified a two-cassette system expressing pieces of the *S. pyogenes* Cas9 (SpCas9) protein which splice together in cellula to form a functional protein capable of site-specific DNA cleavage. With specific CRISPR guide strands, Fine et al. demonstrated the efficacy of this system in cleaving the HBB and CCR5 genes in human HEK-293T cells as a single Cas9 and as a pair of Cas9 nickases. The trans-spliced SpCas9 (tsSpCas9) displayed ~35% of the nuclease activity compared with the wild-type SpCas9 (wt-SpCas9) at standard transfection doses, but had substantially decreased activity at lower dosing levels. The greatly reduced open reading frame length of the tsSpCas9 relative to wtSpCas9 potentially allows for more complex and longer genetic elements to be packaged into an AAV vector including tissue-specific promoters, multiplexed guide RNA expression, and effector domain fusions to SpCas9.

Li et al. (J Gen Virol. 2015 August; 96(8):2381-93. doi: 10.1099/vir.0.000139. Epub 2015 Apr. 8) demonstrated that CRISPR-Cas9 can efficiently mediate the editing of the CCR5 locus in cell lines, resulting in the knockout of CCR5 expression on the cell surface. Next-generation sequencing revealed that various mutations were introduced around the predicted cleavage site of CCR5. For each of the three most effective guide RNAs that were analyzed, no significant off-target effects were detected at the 15 top-scoring potential sites. By constructing chimeric Ad5F35 adenoviruses carrying CRISPR-Cas9 components, Li et al. efficiently transduced primary CD4+T-lymphocytes and disrupted CCR5 expression, and the positively transduced cells were conferred with HIV-1 resistance.

One of skill in the art may utilize the above studies of, for example, Holt, N., et al. Nature biotechnology 28, 839-847 (2010), Li, L., et al. Molecular therapy: the journal of the American Society of Gene Therapy 21, 1259-1269 (2013), Mandal et al., Cell Stem Cell, Volume 15, Issue 5, p 643-652, 6 Nov. 2014, Wang et al. (PLoS One. 2014 Dec. 26; 9(12):e115987. doi: 10.1371/journal.pone.0115987), Fine et al. (Sci Rep. 2015 Jul. 1; 5:10777. doi: 10.1038/srep10777) and Li et al. (J Gen Virol. 2015 August; 96(8): 2381-93. doi: 10.1099/vir.0.000139. Epub 2015 Apr. 8) for targeting CCR5 with the CRISPR Cas system of the present invention. With respect to the C2c1 protein, the CRISPR-C2c1 system may recognize a PAM sequence that is 5' TTN 3' or 5' ATTN 3', wherein N is any nucleotide. Notably, the T-rich PAM allows application of the present invention in non-dividing cells and tissues. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Treating Pathogens, Like Viral Pathogens, Such as HBV

The present invention may also be applied to treat hepatitis B virus (HBV). However, the CRISPR Cas system must be adapted to avoid the shortcomings of RNAi, such as the risk of overstating endogenous small RNA pathways, by for example, optimizing dose and sequence (see, e.g., Grimm et al., Nature vol. 441, 26 May 2006). For example, low doses, such as about 1-10×$10^4$ particles per human are contemplated. In another embodiment, the CRISPR Cas system directed against HBV may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of CRISPR Cas targeted to HBV RNA in a SNALP are contemplated. The daily treatment may be over about three days and then weekly for about five weeks. In another embodiment, the system of Chen et al. (Gene Therapy (2007) 14, 11-19) may be used/and or adapted for the CRISPR Cas system of the present invention. Chen et al. use a double-stranded adenoassociated virus 8-pseudotyped vector (dsAAV2/8) to deliver shRNA. A single administration of dsAAV2/8 vector (1×$10^{12}$ vector genomes per mouse), carrying HBV-specific shRNA, effectively suppressed the steady level of HBV protein, mRNA and replicative DNA in liver of HBV transgenic mice, leading to up to 2-3 log 10 decrease in HBV load in the circulation. Significant HBV suppression sustained for at least 120 days after vector administration. The therapeutic effect of shRNA was target sequence dependent and did not involve activation of interferon. For the present invention, a CRISPR Cas system directed to HBV may be cloned into an AAV vector, such as a dsAAV2/8 vector and administered to a human, for example, at a dosage of about 1×$10^{15}$ vector genomes to about 1×$10^{16}$ vector genomes per human. In another embodiment, the method of Wooddell et al. (Molecular Therapy vol. 21 no. 5, 973-985 May 2013) may be used/and or adapted to the CRISPR Cas system of the present invention. Woodell et al. show that simple coinjection of a hepatocyte-targeted, N-acetylgalactosamine-conjugated melittin-like peptide (NAG-MLP) with a liver-tropic cholesterol-conjugated siRNA (chol-siRNA) targeting coagulation factor VII (F7) results in efficient F7 knockdown in mice and nonhuman primates without changes in clinical chemistry or induction of cytokines. Using transient and transgenic mouse models of HBV infection, Wooddell et al. show that a single coinjection of NAG-MLP with potent chol-siRNAs targeting conserved HBV sequences resulted in multilog repression of viral RNA, proteins, and viral DNA with long duration of effect. Intravenous coinjections, for example, of about 6 mg/kg of NAG-MLP and 6 mg/kg of HBV specific CRISPR Cas may be envisioned for the present invention. In the alternative, about 3 mg/kg of NAG-MLP and 3 mg/kg of HBV specific CRISPR Cas may be delivered on day one, followed by administration of about 2-3 mg/kg of NAG-MLP and 2-3 mg/kg of HBV specific CRISPR Cas two weeks later.

In some embodiments, the target sequence is an HBV sequence. In some embodiments, the target sequences are comprised in an episomal viral nucleic acid molecule which is not integrated into the genome of the organism to thereby manipulate the episomal viral nucleic acid molecule. In some embodiments, the episomal nucleic acid molecule is a double-stranded DNA polynucleotide molecule or is a covalently closed circular DNA (cccDNA). In some embodiments, the CRISPR complex is capable of reducing the amount of episomal viral nucleic acid molecule in a cell of the organism compared to the amount of episomal viral nucleic acid molecule in a cell of the organism in the absence of providing the complex, or is capable of manipulating the episomal viral nucleic acid molecule to promote degradation of the episomal nucleic acid molecule. In some embodiments, the target HBV sequence is integrated into the genome of the organism. In some embodiments, when formed within the cell, the CRISPR complex is capable of manipulating the integrated nucleic acid to promote excision of all or part of the target HBV nucleic acid from the genome of the organism. In some embodiments, said at least one target HBV nucleic acid is comprised in a double-stranded DNA polynucleotide cccDNA molecule and/or viral DNA integrated into the genome of the organism and wherein the CRISPR complex manipulates at least one target HBV nucleic acid to cleave viral cccDNA and/or integrated viral DNA. In some embodiments, said cleavage comprises one or more double-strand break(s) introduced into the viral cccDNA and/or integrated viral DNA, optionally at least two double-strand break(s). In some embodiments, said cleavage is via one or more single-strand break(s) introduced into the viral cccDNA and/or integrated viral DNA, optionally at least two single-strand break(s). In some embodiments, said one or more double-strand break(s) or said one or more single-strand break(s) leads to the formation of one or more insertion or deletion mutations (INDELs) in the viral cccDNA sequences and/or integrated viral DNA sequences. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Lin et al. (Mol Ther Nucleic Acids. 2014 Aug. 19; 3:e186. doi: 10.1038/mtna.2014.38) designed eight gRNAs against HBV of genotype A. With the HBV-specific gRNAs, the CRISPR-Cas9 system significantly reduced the production of HBV core and surface proteins in Huh-7 cells transfected with an HBV-expression vector. Among eight screened gRNAs, two effective ones were identified. One gRNA targeting the conserved HBV sequence acted against different genotypes. Using a hydrodynamics-HBV persistence mouse model, Lin et al. further demonstrated that this system could cleave the intrahepatic HBV genome-containing plasmid and facilitate its clearance in vivo, resulting in reduction of serum surface antigen levels. These data suggest that the CRISPR-Cas9 system could disrupt the HBV-expressing templates both in vitro and in vivo, indicating its potential in eradicating persistent HBV infection.

Dong et al. (Antiviral Res. 2015 June; 118:110-7. doi: 10.1016/j.antiviral.2015.03.015. Epub 2015 Apr. 3) used the CRISPR-Cas9 system to target the HBV genome and efficiently inhibit HBV infection. Dong et al. synthesized four single-guide RNAs (guide RNAs) targeting the conserved regions of HBV. The expression of these guide RNAS with Cas9 reduced the viral production in Huh7 cells as well as in HBV-replication cell HepG2.2.15. Dong et al. further demonstrated that CRISPR-Cas9 direct cleavage and cleavage-mediated mutagenesis occurred in HBV cccDNA of transfected cells. In the mouse model carrying HBV cccDNA, injection of guide RNA-Cas9 plasmids via rapid tail vein resulted in the low level of cccDNA and HBV protein.

Liu et al. (J Gen Virol. 2015 August; 96(8):2252-61. doi: 10.1099/vir.0.000159. Epub 2015 Apr. 22) designed eight guide RNAs (gRNAs) that targeted the conserved regions of different HBV genotypes, which could significantly inhibit HBV replication both in vitro and in vivo to investigate the possibility of using the CRISPR-Cas9 system to disrupt the HBV DNA templates. The HBV-specific gRNA/C2c1 system could inhibit the replication of HBV of different genotypes in cells, and the viral DNA was significantly reduced by a single gRNA/C2c1 system and cleared by a combination of different gRNA/C2c1 systems.

Wang et al. (World J Gastroenterol. 2015 Aug. 28; 21(32): 9554-65. doi: 10.3748/wjg.v21.i32.9554) designed 15 gRNAs against HBV of genotypes A-D. Eleven combinations of two above gRNAs (dual-gRNAs) covering the regulatory region of HBV were chosen. The efficiency of each gRNA and 11 dual-gRNAs on the suppression of HBV (genotypes A-D) replication was examined by the measurement of HBV surface antigen (HBsAg) or e antigen (HBeAg) in the culture supernatant. The destruction of HBV-expressing vector was examined in HuH7 cells co-transfected with dual-gRNAs and HBV-expressing vector using polymerase chain reaction (PCR) and sequencing method, and the destruction of cccDNA was examined in HepAD38 cells using KCl precipitation, plasmid-safe ATP-dependent DNase (PSAD) digestion, rolling circle amplification and quantitative PCR combined method. The cytotoxicity of these gRNAs was assessed by a mitochondrial tetrazolium assay. All of gRNAs could significantly reduce HBsAg or HBeAg production in the culture supernatant, which was dependent on the region in which gRNA against. All of dual gRNAs could efficiently suppress HBsAg and/or HBeAg production for HBV of genotypes A-D, and the efficacy of dual gRNAs in suppressing HBsAg and/or HBeAg production was significantly increased when compared to the single gRNA used alone. Furthermore, by PCR direct sequencing we confirmed that these dual gRNAs could specifically destroy HBV expressing template by removing the fragment between the cleavage sites of the two used gRNAs. Most importantly, gRNA-5 and gRNA-12 combination not only could efficiently suppress HBsAg and/or HBeAg production, but also destroy the cccDNA reservoirs in HepAD38 cells.

Karimova et al. (Sci Rep. 2015 Sep. 3; 5:13734. doi: 10.1038/srep13734) identified cross-genotype conserved HBV sequences in the S and X region of the HBV genome that were targeted for specific and effective cleavage by a Cas9 nickase. This approach disrupted not only episomal cccDNA and chromosomally integrated HBV target sites in reporter cell lines, but also HBV replication in chronically and de novo infected hepatoma cell lines.

One of skill in the art may utilize the above studies of, for example, Lin et al. (Mol Ther Nucleic Acids. 2014 Aug. 19; 3:e186. doi: 10.1038/mtna.2014.38), Dong et al. (Antiviral Res. 2015 June; 118:110-7. doi: 10.1016/j.antiviral.2015.03.015. Epub 2015 Apr. 3), Liu et al. (J Gen Virol. 2015 August; 96(8):2252-61. doi: 10.1099/vir.0.000159. Epub 2015 Apr. 22), Wang et al. (World J Gastroenterol. 2015 Aug. 28; 21(32):9554-65. doi: 10.3748/wjg.v21.i32.9554) and Karimova et al. (Sci Rep. 2015 Sep. 3; 5:13734. doi: 10.1038/srep13734) for targeting HBV with the CRISPR Cas system of the present invention. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Chronic hepatitis B virus (HBV) infection is prevalent, deadly, and seldom cured due to the persistence of viral episomal DNA (cccDNA) in infected cells. Ramanan et al. (Ramanan V, Shlomai A, Cox D B, Schwartz R E, Michailidis E, Bhatta A, Scott D A, Zhang F, Rice C M, Bhatia S N, Sci Rep. 2015 Jun. 2; 5:10833. doi: 10.1038/srep10833, published online 2 Jun. 2015.) showed that the CRISPR/Cas9 system can specifically target and cleave conserved regions in the HBV genome, resulting in robust suppression of viral gene expression and replication. Upon sustained expression of Cas9 and appropriately chosen guide RNAs, they demonstrated cleavage of cccDNA by Cas9 and a dramatic reduction in both cccDNA and other parameters of viral gene expression and replication. Thus, they showed that directly targeting viral episomal DNA is a novel therapeutic approach to control the virus and possibly cure patients. This is also described in WO2015089465 A1, in the name of The Broad Institute et al., the contents of which are hereby incorporated by reference.

As such targeting viral episomal DNA in HBV is preferred in some embodiments.

The present invention may also be applied to treat pathogens, e.g., bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria.

The present invention may also be applied to treat hepatitis C virus (HCV). The methods of Roelvinki et al. (Molecular Therapy vol. 20 no. 9, 1737-1749 September 2012) may be applied to the CRISPR Cas system. For example, an AAV vector such as AAV8 may be a contemplated vector and for example a dosage of about $1.25\times10^{11}$ to $1.25\times10^{13}$ vector genomes per kilogram body weight (vg/kg) may be contemplated. The present invention may also be applied to treat pathogens, e.g., bacterial, fungal and parasitic pathogens. Most research efforts have focused on developing new antibiotics, which once developed, would nevertheless be subject to the same problems of drug resistance. The invention provides novel CRISPR-based alternatives which overcome those difficulties. Furthermore, unlike existing antibiotics, CRISPR-based treatments can be made pathogen specific, inducing bacterial cell death of a target pathogen while avoiding beneficial bacteria. In some embodiments, the CRISPR-C2c1 system may recognize a PAM sequence is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Jiang et al. ("RNA-guided editing of bacterial genomes using CRISPR-Cas systems," Nature Biotechnology vol. 31, p. 233-9, March 2013) used a CRISPR-Cas9 system to mutate or kill *S. pneumoniae* and *E. coli*. The work, which introduced precise mutations into the genomes, relied on dual-RNA:Cas9-directed cleavage at the targeted genomic site to kill unmutated cells and circumvented the need for selectable markers or counter-selection systems. CRISPR systems have be used to reverse antibiotic resistance and eliminate the transfer of resistance between strains. Bickard et al. showed that Cas9, reprogrammed to target virulence genes, kills virulent, but not avirulent, *S. aureus*. Reprogramming the nuclease to target antibiotic resistance genes destroyed staphylococcal plasmids that harbor antibiotic resistance genes and immunized against the spread of plasmid-borne resistance genes. (see, Bikard et al., "Exploiting CRISPR-Cas nucleases to produce sequence-specific antimicrobials," Nature Biotechnology vol. 32, 1146-1150, doi: 10.1038/nbt.3043, published online 5 Oct. 2014.) Bikard showed that CRISPR-Cas9 antimicrobials function in vivo to kill *S. aureus* in a mouse skin colonization model. Similarly, Yosef et al used a CRISPR system to target genes encoding enzymes that confer resistance to β-lactam antibiotics (see Yousef et al., "Temperate and lytic bacteriophages programmed to sensitize and kill antibiotic-resistant bacteria," Proc. Natl. Acad. Sci. USA, vol. 112, p. 7267-7272, doi: 10.1073/pnas.1500107112 published online May 18, 2015).

The present invention may also be applied to development of treatment to norovirus infections. Norovirus is one of the most common pathogens attributed to diarrheal diseases from unsafe food. It is also the primary cause of mortality among young children and adults in foodborne infections. Norovirus is not just a foodborne burden. In a recent meta-analysis, norovirus accounts for nearly one-fifth of all causes of (including person-to-person transmission) acute gastroenteritis in both sporadic and outbreak settings and affects all age groups. Undoubtedly, norovirus is of paramount public health concern in both developed and developing countries. Research efforts to better understand norovirus pathobiology will be necessary for targeted intervention. From Middle East respiratory syndrome coronavirus to Zika virus, efforts to identify host factors important for mediating virus infection has always been a research priority. Such information will shed light on potential therapeutic targets in antiviral intervention. Norovirus virus-host interaction studies have been hampered by the lack of a robust cell culture model in the past 20 years. In 2016, norovirus has finally been successfully cultivated in a stem cell-derived three-dimensional human gut-like structure called enteroid or mini-gut. Chan et. al used intestinal stem cells isolated from duodenal biopsies collected from participants, followed by differentiation into mini-guts. Knockout CRISPR and gain-of-function CRISPR SAM, were used to identify shortlisted candidates of genes involved in norovirus infection. The C2c1-CRISPR system disclosed in this invention may be used in a similar system as in Chan et al. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

The present invention may also be applied to treat human papillomavirus (HPV) related malignant neoplasm and HPV induced cervical cancer. Cervical cancer is the second most common cancer in women worldwide. High-risk human papillomavirus (HR-HPVs), especially HPV16 and HPV18, is considered major causative agent for cervical cancer. Oncogenes E6 and E7 are expressed in the early stage of HPV infection, and their functions are to disrupt normal cell cycle and to maintain a transformed malignant phenotype.

For instance, E7 protein binds to cullin 2 ubiquitin ligase complex and leads to the ubiquitination and degradation of the retinoblastoma (pRb) tumor suppressor.

Hu et. al (Biomed Res Int. 2014; 2014:612823. doi: 10.1155/2014/61283) used CRISPR-Cas9 system to target HPV16-E7 DNA in HPV positive cell lines and showed that the HPV16-E7 single-guide RNA (sgRNA) guided CRISPR/Cas system could disrupt HPV16-E7 DNA at specific sites, inducing apoptosis and growth inhibition in HPV positive SiHa and Caski cells, but not in HPV negative C33A and HEK293 cells. Moreover, disruption of E7 DNA directly leads to downregulation of E7 protein and upregulation of tumor suppressor protein pRb. gRNAs targeting HPV16-E7 gene was designed following the protocol of Mali et al. and synthesized them in Genewiz Company (China). SSA luciferase reporter pSSA Rep3-1 was used as a reporting system of delivery of the CRISPR system. The cells were cotransfected with 0.8 μg of Cas9 plasmid and 0.2 μg of gRNA plasmid in 24-well plates. At 48 h after transfection, they were collected and double stained with fluorescein isothiocyanate- (FITC-) conjugated annexin V (annexin V-FITC) and propidium iodide (PI) using an Annexin V-FITC Apoptosis detection kit (KeyGen BioTech) according to the manufacturer's instructions. Apoptosis rates of all of the four CRISPR/Cas system treated cell lines were analyzed using a FACS Calibur (BD Bioscience) to calculate the induced cell death. Data was analyzed using BD Cell Quest software. In vitro cell proliferation was determined using Cell Counting Kit-8 (CCK-8; Beyotime). Transfected with the gRNA-4/Cas9 plasmids with $1\times10^4$ cells/well, cells were trypsinized and seeded onto 96-well plates at 24 h after transfection. At 0 h, 24 h, 48 h, 72 h, and 96 h after being seeded onto 96-well plates, 10 μL CCK-8 solution was added in each well followed by 2.5 h incubation at 37° C. The CRISPR-C2c1 system disclosed in this invention may be used in a similar system. With respect to the C2c1 protein, the CRISPR-C2c1 system may recognize a PAM sequence that is 5' TTN 3' or 5' ATTN 3', wherein N is any nucleotide. In some embodiments, the CRISPR-C2c1 system introduces one or more staggered double strand breaks (DSBs) a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

CRISPR systems can be used to edit genomes of parasites that are resistant to other genetic approaches. For example, a CRISPR-Cas9 system was shown to introduce double-stranded breaks into the in the *Plasmodium yoelii* genome (see, Zhang et al., "Efficient Editing of Malaria Parasite Genome Using the CRISPR/Cas9 System," mBio. vol. 5, e01414-14, July-August 2014). Ghorbal et al. ("Genome editing in the human malaria parasite *Plasmodium falciparum* using the CRISPR-Cas9 system," Nature Biotechnology, vol. 32, p. 819-821, doi: 10.1038/nbt.2925, published online Jun. 1, 2014) modified the sequences of two genes, orc1 and kelch13, which have putative roles in gene silencing and emerging resistance to artemisinin, respectively. Parasites that were altered at the appropriate sites were recovered with very high efficiency, despite there being no direct selection for the modification, indicating that neutral or even deleterious mutations can be generated using this system. CRISPR-Cas9 is also used to modify the genomes of other pathogenic parasites, including *Toxoplasma gondii* (see Shen et al., "Efficient gene disruption in diverse strains of *Toxoplasma gondii* using CRISPR/CAS9," mBio vol. 5:e01114-14, 2014; and Sidik et al., "Efficient Genome Engineering of *Toxoplasma gondii* Using CRISPR/Cas9," PLoS One vol. 9, e100450, doi: 10.1371/journal.pone.0100450, published online Jun. 27, 2014). The C2c1 effector protein may be applied to a similar system. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript.

Vyas et al. ("A *Candida albicans* CRISPR system permits genetic engineering of essential genes and gene families," Science Advances, vol. 1, e1500248, DOI: 10.1126/sciadv.1500248, Apr. 3, 2015) employed a CRISPR system to overcome long-standing obstacles to genetic engineering in *C. albicans* and efficiently mutate in a single experiment both copies of several different genes. In an organism where several mechanisms contribute to drug resistance, Vyas produced homozygous double mutants that no longer displayed the hyper-resistance to fluconazole or cycloheximide displayed by the parental clinical isolate Can90. Vyas also obtained homozygous loss-of-function mutations in essential genes of *C. albicans* by creating conditional alleles. Null alleles of DCR1, which is required for ribosomal RNA processing, are lethal at low temperature but viable at high temperature. Vyas used a repair template that introduced a nonsense mutation and isolated dcr1/dcr1 mutants that failed to grow at 16° C. The C2c1 effector protein may be applied to a similar system. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of DCR1. In some embodiments, the repair template does not comprise a PAM sequence.

Treating Diseases with Genetic or Epigenetic Aspects

The CRISPR-Cas systems of the present invention can be used to correct genetic mutations that were previously attempted with limited success using TALEN and ZFN and have been identified as potential targets for Cas9 systems, including as in published applications of Editas Medicine describing methods to use Cas9 systems to target loci to therapeutically address disesaes with gene therapy, including, WO 2015/048577 CRISPR-RELATED METHODS AND COMPOSITIONS of Gluckmann et al.; WO 2015/070083 CRISPR-RELATED METHODS AND COMPOSITIONS WITH GOVERNING gRNAS of Glucksmann et al. In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference.

Mention is made of WO2015/134812 CRISPR/CAS-RELATED METHODS AND COMPOSITIONS FOR TREATING USHER SYNDROME AND RETINITIS PIGMENTOSA of Maeder et al. Through the teachings herein the invention comprehends methods and materials of these documents applied in conjunction with the teachings herein. In an aspect of ocular and auditory gene therapy, methods and compositions for treating Usher Syndrome and Retinis-Pigmentosa may be adapted to the CRISPR-Cas system of the present invention (see, e.g., WO 2015/134812). In an embodiment, the WO 2015/134812 involves a treatment or delaying the onset or progression of Usher Syndrome type IIA (USH2A, USH11A) and retinitis pigmentosa 39 (RP39) by gene editing, e.g., using CRISPR-Cas9 mediated methods to correct the guanine deletion at position 2299 in the USH2A gene (e.g., replace the deleted guanine residue at position 2299 in the USH2A gene). A similar effect can be achieved with C2c1. In a related aspect, a mutation is targeted by cleaving with either one or more nuclease, one or more nickase, or a combination thereof, e.g., to induce HDR with a donor template that corrects the point mutation (e.g., the single nucleotide, e.g., guanine, deletion). The alteration or correction of the mutant USH2A gene can be mediated by any mechanism. Exemplary mechanisms that can be associated with the alteration (e.g., correction) of the mutant HSH2A gene include, but are not limited to, non-homologous end joining, microhomology-mediated end joining (MMEJ), homology-directed repair (e.g., endogenous donor template mediated), SDSA (synthesis dependent strand annealing), single-strand annealing or single strand invasion. In an embodiment, the method used for treating Usher Syndrome and Retinis-Pigmentosa can include acquiring knowledge of the mutation carried by the subject, e.g., by sequencing the appropriate portion of the USH2A gene.

Accordingly, in some embodiments, the treatment, prophylaxis or diagnosis of Retinitis Pigmentosa is provided. A number of different genes are known to be associated with or result in Retinitis Pigmentosa, such as RP1, RP2 and so forth. These genes are targeted in some embodiments and either knocked out or repaired through provision of suitable a template. In some embodiments, delivery is to the eye by injection.

One or more Retinitis Pigmentosa genes can, in some embodiements, be selected from: RP1 (Retinitis pigmentosa-1), RP2 (Retinitis pigmentosa-2), RPGR (Retinitis pigmentosa-3), PRPH2 (Retinitis pigmentosa-7), RP9 (Retinitis pigmentosa-9), IMPDH1 (Retinitis pigmentosa-10), PRPF31 (Retinitis pigmentosa-11), CRB1 (Retinitis pigmentosa-12, autosomal recessive), PRPF8 (Retinitis pigmentosa-13), TULP1 (Retinitis pigmentosa-14), CA4 (Retinitis pigmentosa-17), HPRPF3 (Retinitis pigmentosa-18), ABCA4 (Retinitis pigmentosa-19), EYS (Retinitis pigmentosa-25), CERKL (Retinitis pigmentosa-26), FSCN2 (Retinitis pigmentosa-30), TOPORS (Retinitis pigmentosa-31), SNRNP200 (Retinitis pigmentosa 33), SEMA4A (Retinitis pigmentosa-35), PRCD (Retinitis pigmentosa-36), NR2E3 (Retinitis pigmentosa-37), MERTK (Retinitis pigmentosa-38), USH2A (Retinitis pigmentosa-39), PROM1 (Retinitis pigmentosa-41), KLHL7 (Retinitis pigmentosa-42), CNGB1 (Retinitis pigmentosa-45), BEST1 (Retinitis pigmentosa-50), TTC8 (Retinitis pigmentosa 51), C2orf71 (Retinitis pigmentosa 54), ARL6 (Retinitis pigmentosa 55), ZNF513 (Retinitis pigmentosa 58), DHDDS (Retinitis pigmentosa 59), BEST1 (Retinitis pigmentosa, concentric), PRPH2 (Retinitis pigmentosa, digenic), LRAT (Retinitis pigmentosa, juvenile), SPATA7 (Retinitis pigmentosa, juvenile, autosomal recessive), CRX (Retinitis pigmentosa, late-onset dominant), and/or RPGR (Retinitis pigmentosa, X-linked, and sinorespiratory infections, with or without deafness).

In some embodiments, the Retinitis Pigmentosa gene is MERTK (Retinitis pigmentosa-38) or USH2A (Retinitis pigmentosa-39).

Mention is also made of WO 2015/138510 and through the teachings herein the invention (using a CRISPR-Cas9 system) comprehends providing a treatment or delaying the onset or progression of Leber's Congenital Amaurosis 10 (LCA 10). LCA 10 is caused by a mutation in the CEP290 gene, e.g., a c.2991+1655, adenine to guanine mutation in the CEP290 gene which gives rise to a cryptic splice site in intron 26. This is a mutation at nucleotide 1655 of intron 26 of CEP290, e.g., an A to G mutation. CEP290 is also known as: CT87; MKS4; POC3; rd16; BBS14; JBTS5; LCAJO; NPHP6; SLSN6; and 3H11Ag (see, e.g., WO 2015/138510). In an aspect of gene therapy, the invention involves introducing one or more breaks near the site of the LCA target position (e.g., c.2991+1655; A to G) in at least one allele of the CEP290 gene. Altering the LCA10 target position refers to (1) break-induced introduction of an indel (also referred to herein as NHEJ-mediated introduction of an indel) in close proximity to or including a LCA10 target position (e.g., c.2991+1655A to G), or (2) break-induced deletion (also referred to herein as NHEJ-mediated deletion) of genomic sequence including the mutation at a LCA10 target position (e.g., c.2991+1655A to G). Both approaches give rise to the loss or destruction of the cryptic splice site resulting from the mutation at the LCA 10 target position. Accordingly, the use of C2c1 in the treatment of LCA is specifically envisaged.

Researchers are contemplating whether gene therapies could be employed to treat a wide range of diseases. The CRISPR systems of the present invention based on C2c1 effector protein are envisioned for such therapeutic uses, including, but not limited to, further exemplified targeted areas and with delivery methods as below. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene. Some examples of conditions or diseases that might be usefully treated using the present system are included in the examples of genes and references included herein and are currently associated with those conditions are also provided there. The genes and conditions exemplified are not exhaustive.

Treating Diseases of the Circulatory System

The present invention also contemplates delivering the CRISPR-Cas system, specifically the novel CRISPR effector protein systems described herein, to the blood or hematopoietic stem cells. The plasma exosomes of Wahlgren et al. (Nucleic Acids Research, 2012, Vol. 40, No. 17 e130) were previously described and may be utilized to deliver the CRISPR Cas system to the blood. The nucleic acid-targeting system of the present invention is also contemplated to treat hemoglobinopathies, such as thalassemias and sickle cell disease. See, e.g., International Patent Publication No. WO 2013/126794 for potential targets that may be targeted by the CRISPR Cas system of the present invention.

Drakopoulou, "Review Article, The Ongoing Challenge of Hematopoietic Stem Cell-Based Gene Therapy for β-Thalassemia," Stem Cells International, Volume 2011, Article ID 987980, 10 pages, doi:10.4061/2011/987980, incorporated herein by reference along with the documents it cites, as if set out in full, discuss modifying HSCs using a lentivirus that delivers a gene for β-globin or γ-globin. In contrast to using lentivirus, with the knowledge in the art and the teachings in this disclosure, the skilled person can correct HSCs as to β-Thalassemia using a CRISPR-Cas system that targets and corrects the mutation (e.g., with a suitable HDR template that delivers a coding sequence for β-globin or γ-globin, advantageously non-sickling β-globin or γ-globin); specifically, the guide RNA can target mutation that give rise to β-Thalassemia, and the HDR can provide coding for proper expression of β-globin or γ-globin. A guide RNA that targets the mutation-and-Cas protein containing particle is contacted with HSCs carrying the mutation. The particle also can contain a suitable HDR template to correct the mutation for proper expression of β-globin or γ-globin; or the HSC can be contacted with a second particle or a vector that contains or delivers the HDR template. The so contacted cells can be administered and optionally treated/expanded; cf. Cartier. In this regard mention is made of: Cavazzana, "Outcomes of Gene Therapy for β-Thalassemia Major via Transplantation of Autologous Hematopoietic Stem Cells Transduced Ex Vivo with a Lentiviral βA-T87Q-Globin Vector." tif2014.org/abstractFiles/Jean %20Antoine %20Ribeil_Abstract.pdf; Cavazzana-Calvo, "Transfusion independence and HMGA2 activation after gene therapy of human β-thalassaemia", Nature 467, 318-322 (16 Sep. 2010) doi:10.1038/nature09328; Nienhuis, "Development of Gene Therapy for Thalassemia, Cold Spring Harbor Perpsectives in Medicine, doi: 10.1101/cshperspect.a011833 (2012), LentiGlobin BB305, a lentiviral vector containing an engineered β-globin gene (βA-T87Q); and Xie et al., "Seamless gene correction of β-thalassaemia mutations in patient-specific iPSCs using CRISPR/Cas9 and piggyback" Genome Research gr.173427.114 (2014) genome.org/cgi/doi/10.1101/gr.173427.114 (Cold Spring Harbor Laboratory Press); that is the subject of Cavazzana work involving human β-thalassaemia and the subject of the Xie work, are all incorporated herein by reference, together with all documents cited therein or associated therewith. In the instant invention, the HDR template can provide for the HSC to express an engineered β-globin gene (e.g., βA-T87Q), or β-globin as in Xie.

Xu et al. (Sci Rep. 2015 Jul. 9; 5:12065. doi: 10.1038/srep12065) have designed TALENs and CRISPR-Cas9 to directly target the intron2 mutation site IVS2-654 in the globin gene. Xu et al. observed different frequencies of double-strand breaks (DSBs) at IVS2-654 loci using TALENs and CRISPR-Cas9, and TALENs mediated a higher homologous gene targeting efficiency compared to CRISPR-Cas9 when combined with the piggyBac transposon donor. In addition, more obvious off-target events were observed for CRISPR-Cas9 compared to TALENs. Finally, TALENs-corrected iPSC clones were selected for erythroblast differentiation using the OP9 co-culture system and detected relatively higher transcription of HBB than the uncorrected cells.

Song et al. (Stem Cells Dev. 2015 May 1; 24(9):1053-65. doi: 10.1089/scd.2014.0347. Epub 2015 Feb. 5) used CRISPR/Cas9 to correct β-Thal iPSCs; gene-corrected cells exhibit normal karyotypes and full pluripotency as human embryonic stem cells (hESCs) showed no off-targeting effects. Then, Song et al. evaluated the differentiation efficiency of the gene-corrected β-Thal iPSCs. Song et al. found that during hematopoietic differentiation, gene-corrected β-Thal iPSCs showed an increased embryoid body ratio and various hematopoietic progenitor cell percentages. More importantly, the gene-corrected β-Thal iPSC lines restored HBB expression and reduced reactive oxygen species production compared with the uncorrected group. Song et al.'s study suggested that hematopoietic differentiation efficiency of β-Thal iPSCs was greatly improved once corrected by the CRISPR-Cas9 system. Similar methods may be performed utilizing the CRISPR-Cas systems described herein, e.g., systems comprising C2c1 effector proteins.

Sickle cell anemia is an autosomal recessive genetic disease in which red blood cells become sickle-shaped. It is caused by a single base substitution in the β-globin gene, which is located on the short arm of chromosome 11. As a result, valine is produced instead of glutamic acid causing the production of sickle hemoglobin (HbS). This results in the formation of a distorted shape of the erythrocytes. Due to this abnormal shape, small blood vessels can be blocked, causing serious damage to the bone, spleen and skin tissues. This may lead to episodes of pain, frequent infections, hand-foot syndrome or even multiple organ failure. The distorted erythrocytes are also more susceptible to hemolysis, which leads to serious anemia. As in the case of β-thalassaemia, sickle cell anemia can be corrected by modifying HSCs with the CRISPR-Cas system. The system allows the specific editing of the cell's genome by cutting its DNA and then letting it repair itself. The Cas protein is inserted and directed by an RNA guide to the mutated point and then it cuts the DNA at that point. Simultaneously, a healthy version of the sequence is inserted. This sequence is used by the cell's own repair system to fix the induced cut. In this way, the CRISPR-Cas allows the correction of the mutation in the previously obtained stem cells. With the knowledge in the art and the teachings in this disclosure, the skilled person can correct HSCs as to sickle cell anemia using a CRISPR-Cas system that targets and corrects the mutation (e.g., with a suitable HDR template that delivers a coding sequence for β-globin, advantageously non-sickling β-globin); specifically, the guide RNA can target mutation that give rise to sickle cell anemia, and the HDR can provide coding for proper expression of β-globin. A guide RNA that targets the mutation-and-Cas protein containing particle is contacted with HSCs carrying the mutation. The particle also can contain a suitable HDR template to correct the mutation for proper expression of β-globin; or the HSC can be contacted with a second particle or a vector that contains or delivers the HDR template. The so contacted cells can be administered and optionally treated/expanded; cf. Cartier. The HDR template can provide for the HSC to express an engineered β-globin gene (e.g., βA-T87Q), or β-globin as in Xie.

Williams, "Broadening the Indications for Hematopoietic Stem Cell Genetic Therapies," Cell Stem Cell 13:263-264 (2013), incorporated herein by reference along with the documents it cites, as if set out in full, reports lentivirus-mediated gene transfer into HSC/P cells from patients with the lysosomal storage disease, metachromatic leukodystrophy disease (MILD), a genetic disease caused by deficiency of arylsulfatase A (ARSA), resulting in nerve demyelination; and lentivirus-mediated gene transfer into HSCs of patients with Wiskott-Aldrich syndrome (WAS) (patients with defective WAS protein, an effector of the small GTPase CDC42 that regulates cytoskeletal function in blood cell lineages and thus suffer from immune deficiency with recurrent infections, autoimmune symptoms, and thrombocytopenia with abnormally small and dysfunctional platelets leading to excessive bleeding and an increased risk of leukemia and lymphoma). In contrast to using lentivirus, with the knowledge in the art and the teachings in this disclosure, the skilled person can correct HSCs as to MILD (deficiency of arylsulfatase A (ARSA)) using a CRISPR-Cas system that targets and corrects the mutation (deficiency of arylsulfatase A (ARSA)) (e.g., with a suitable HDR template that delivers a coding sequence for ARSA); specifically, the guide RNA can target mutation that gives rise to MILD (deficient ARSA), and the HDR can provide coding for proper expression of ARSA. A guide RNA that targets the mutation-and-Cas protein containing particle is contacted with HSCs carrying the mutation. The particle also can contain a suitable HDR template to correct the mutation for proper expression of ARSA; or the HSC can be contacted with a second particle or a vector that contains or delivers the HDR template. The so contacted cells can be administered and optionally treated/expanded; cf. Cartier. In contrast to using lentivirus, with the knowledge in the art and the teachings in this disclosure, the skilled person can correct HSCs as to WAS using a CRISPR-Cas system that targets and corrects the mutation (deficiency of WAS protein) (e.g., with a suitable HDR template that delivers a coding sequence for WAS protein); specifically, the guide RNA can target mutation that gives rise to WAS (deficient WAS protein), and the HDR can provide coding for proper expression of WAS protein. A guide RNA that targets the mutation-and-C2c1 protein containing particle is contacted with HSCs carrying the mutation. The particle also can contain a suitable HDR template to correct the mutation for proper expression of WAS protein, or the HSC can be contacted with a second particle or a vector that contains or delivers the HDR template. The so contacted cells can be administered, and optionally treated/expanded; cf. Cartier.

Watts, "Hematopoietic Stem Cell Expansion and Gene Therapy" Cytotherapy 13(10):1164-1171. doi:10.3109/14653249.2011.620748 (2011), incorporated herein by reference along with the documents it cites, as if set out in full, discusses hematopoietic stem cell (HSC) gene therapy, e.g., virus-mediated HSC gene therapy, as an highly attractive treatment option for many disorders including hematologic conditions, immunodeficiencies including HIV/AIDS, and other genetic disorders like lysosomal storage diseases, including SCID-X1, ADA-SCID, 0-thalassemia, X-linked CGD, Wiskott-Aldrich syndrome, Fanconi anemia, adrenoleukodystrophy (ALD), and metachromatic leukodystrophy (MLD).

US Patent Publication Nos. 20110225664, 20110091441, 20100229252, 20090271881 and 20090222937 assigned to Cellectis, relates to CREI variants, wherein at least one of the two I-CreI monomers has at least two substitutions, one in each of the two functional subdomains of the LAGLIDADG (SEQ ID NO: 26) core domain situated respectively from positions 26 to 40 and 44 to 77 of I-CreI, said variant being able to cleave a DNA target sequence from the human interleukin-2 receptor gamma chain (IL2RG) gene also named common cytokine receptor gamma chain gene or gamma C gene. The target sequences identified in US Patent Publication Nos. 20110225664, 20110091441, 20100229252, 20090271881 and 20090222937 may be utilized for the nucleic acid-targeting system of the present invention.

Severe Combined Immune Deficiency (SCID) results from a defect in lymphocytes T maturation, always associated with a functional defect in lymphocytes B (Cavazzana-Calvo et al., Annu. Rev. Med., 2005, 56, 585-602; Fischer et al., Immunol. Rev., 2005, 203, 98-109). Overall incidence is estimated to 1 in 75 000 births. Patients with untreated SCID are subject to multiple opportunist micro-organism infections, and do generally not live beyond one year. SCID can be treated by allogenic hematopoietic stem cell transfer, from a familial donor. Histocompatibility with the donor can vary widely. In the case of Adenosine Deaminase (ADA) deficiency, one of the SCID forms, patients can be treated by injection of recombinant Adenosine Deaminase enzyme.

Since the ADA gene has been shown to be mutated in SCID patients (Giblett et al., Lancet, 1972, 2, 1067-1069), several other genes involved in SCID have been identified (Cavazzana-Calvo et al., Annu. Rev. Med., 2005, 56, 585-602; Fischer et al., Immunol. Rev., 2005, 203, 98-109). There are four major causes for SCID: (i) the most frequent form of SCID, SCID-X1 (X-linked SCID or X-SCID), is caused by mutation in the IL2RG gene, resulting in the absence of mature T lymphocytes and NK cells. IL2RG encodes the gamma C protein (Noguchi, et al., Cell, 1993, 73, 147-157), a common component of at least five interleukin receptor complexes. These receptors activate several targets through the JAK3 kinase (Macchi et al., Nature, 1995, 377, 65-68), which inactivation results in the same syndrome as gamma C inactivation; (ii) mutation in the ADA gene results in a defect in purine metabolism that is lethal for lymphocyte precursors, which in turn results in the quasi absence of B, T and NK cells; (iii) V(D)J recombination is an essential step in the maturation of immunoglobulins and T lymphocytes receptors (TCRs). Mutations in Recombination Activating Gene 1 and 2 (RAG1 and RAG2) and Artemis, three genes involved in this process, result in the absence of mature T and B lymphocytes; and (iv) Mutations in other genes such as CD45, involved in T cell specific signaling have also been reported, although they represent a minority of cases (Cavazzana-Calvo et al., Annu. Rev. Med., 2005, 56, 585-602; Fischer et al., Immunol. Rev., 2005, 203, 98-109). Since when their genetic bases have been identified, the different SCID forms have become a paradigm for gene therapy approaches (Fischer et al., Immunol. Rev., 2005, 203, 98-109) for two major reasons. First, as in all blood diseases, an ex vivo treatment can be envisioned. Hematopoietic Stem Cells (HSCs) can be recovered from bone marrow, and keep their pluripotent properties for a few cell divisions. Therefore, they can be treated in vitro, and then reinjected into the patient, where they repopulate the bone marrow. Second, since the maturation of lymphocytes is impaired in SCID patients, corrected cells have a selective advantage. Therefore, a small number of corrected cells can restore a functional immune system. This hypothesis was validated several times by (i) the partial restoration of immune functions associated with the reversion of mutations in SCID patients (Hirschhorn et al., Nat. Genet., 1996, 13, 290-295; Stephan et al., N. Engl. J. Med., 1996, 335, 1563-1567; Bousso et al., Proc. Natl., Acad. Sci. USA, 2000, 97, 274-278; Wada et al., Proc. Natl. Acad. Sci. USA, 2001, 98, 8697-8702; Nishikomori et al., Blood, 2004, 103, 4565-4572), (ii) the correction of SCID-X1 deficiencies in vitro in hematopoietic cells (Candotti et al., Blood, 1996, 87, 3097-3102; Cavazzana-Calvo et al., Blood, 1996, Blood, 88, 3901-3909; Taylor et al., Blood, 1996, 87, 3103-3107; Hacein-Bey et al., Blood, 1998, 92, 4090-4097), (iii) the correction of SCID-X1 (Soudais et al., Blood, 2000, 95, 3071-3077; Tsai et al., Blood, 2002, 100, 72-79), JAK-3 (Bunting et al., Nat. Med., 1998, 4, 58-64; Bunting et al., Hum. Gene Ther., 2000, 11, 2353-2364) and RAG2 (Yates et al., Blood, 2002, 100, 3942-3949) deficiencies in vivo in animal models and (iv) by the result of gene therapy clinical trials (Cavazzana-Calvo et al., Science, 2000, 288, 669-672; Aiuti et al., Nat. Med., 2002; 8, 423-425; Gaspar et al., Lancet, 2004, 364, 2181-2187).

US Patent Publication No. 20110182867 assigned to the Children's Medical Center Corporation and the President and Fellows of Harvard College relates to methods and uses of modulating fetal hemoglobin expression (HbF) in a hematopoietic progenitor cells via inhibitors of BCL11A expression or activity, such as RNAi and antibodies. The targets disclosed in US Patent Publication No. 20110182867, such as BCL11A, may be targeted by the CRISPR Cas system of the present invention for modulating fetal hemoglobin expression. See also Bauer et al. (Science 11 Oct. 2013: Vol. 342 no. 6155 pp. 253-257) and Xu et al. (Science 18 Nov. 2011: Vol. 334 no. 6058 pp. 993-996) for additional BCL11A targets.

With the knowledge in the art and the teachings in this disclosure, the skilled person may correct HSCs as to a genetic hematologic disorder, e.g., β-Thalassemia, Hemophilia, or a genetic lysosomal storage disease with the C2c1-CRISPR system disclosed in this invention and the CRISPR Cas system as described above. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

HSC—Delivery to and Editing of Hematopoietic Stem Cells; and Particular Conditions.

The term "Hematopoietic Stem Cell" or "HSC" is meant to include broadly those cells considered to be an HSC, e.g., blood cells that give rise to all the other blood cells and are derived from mesoderm; located in the red bone marrow, which is contained in the core of most bones. HSCs of the invention include cells having a phenotype of hematopoietic stem cells, identified by small size, lack of lineage (lin) markers, and markers that belong to the cluster of differentiation series, like: CD34, CD38, CD90, CD133, CD105, CD45, and also c-kit, – the receptor for stem cell factor. Hematopoietic stem cells are negative for the markers that are used for detection of lineage commitment, and are, thus, called Lin−; and, during their purification by FACS, a number of up to 14 different mature blood-lineage markers, e.g., CD13 & CD33 for myeloid, CD71 for erythroid, CD19 for B cells, CD61 for megakaryocytic, etc. for humans; and, B220 (murine CD45) for B cells, Mac-1 (CD11b/CD18) for monocytes, Gr-1 for Granulocytes, Ter119 for erythroid cells, Il7Ra, CD3, CD4, CD5, CD8 for T cells, etc. Mouse HSC markers: CD34lo/−, SCA-1+, Thy1.1+/lo, CD38+, C-kit+, lin−, and Human HSC markers: CD34+, CD59+, Thy1/CD90+, CD38lo/−, C-kit/CD117+, and lin−. HSCs are identified by markers. Hence in embodiments discussed herein, the HSCs can be CD34+ cells. HSCs can also be hematopoietic stem cells that are CD34−/CD38−. Stem cells that may lack c-kit on the cell surface that are considered in the art as HSCs are within the ambit of the invention, as well as CD133+ cells likewise considered HSCs in the art.

The CRISPR-Cas (e.g., C2c1) system may be engineered to target genetic locus or loci in HSCs. Cas (e.g., C2c1) protein, advantageously codon-optimized for a eukaryotic cell and especially a mammalian cell, e.g., a human cell, for instance, HSC, and sgRNA targeting a locus or loci in HSC, e.g., the gene EMX1, may be prepared. These may be delivered via particles. The particles may be formed by the Cas (e.g., C2c1) protein and the gRNA being admixed. The gRNA and Cas (e.g., C2c1) protein mixture may for example be admixed with a mixture comprising or consisting essentially of or consisting of surfactant, phospholipid, biodegradable polymer, lipoprotein and alcohol, whereby particles containing the gRNA and Cas (e.g., C2c1) protein may be formed. The invention comprehends so making particles and particles from such a method as well as uses thereof. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

More generally, particles may be formed using an efficient process. First, Cas (e.g., C2c1) protein and gRNA targeting the gene EMX1 or the control gene LacZ may be mixed together at a suitable, e.g., 3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol may be dissolved in an alcohol, advantageously a C1-6 alkyl alcohol, such as methanol, ethanol, isopropanol, e.g., 100% ethanol. The two solutions may be mixed together to form particles containing the Cas (e.g., C2c1)-gRNA complexes. In certain embodiments the particle can contain an HDR template. That can be a particle co-administered with gRNA+Cas (e.g., C2c1) protein-containing particle, or i.e., in addition to contacting an HSC with an gRNA+Cas (e.g., C2c1) protein-containing particle, the HSC is contacted with a particle containing an HDR template; or the HSC is contacted with a particle containing all of the gRNA, Cas (e.g., C2c1) and the HDR template. The HDR template can be administered by a separate vector, whereby in a first instance the particle penetrates an HSC cell, and the separate vector also penetrates the cell, wherein the HSC genome is modified by the gRNA+Cas (e.g., C2c1) and the HDR template is also present, whereby a genomic locus is modified by the HDR; for instance, this may result in correcting a mutation.

After the particles form, HSCs in 96 well plates may be transfected with 15 ug Cas (e.g., C2c1) protein per well. Three days after transfection, HSCs may be harvested, and the number of insertions and deletions (indels) at the EMX1 locus may be quantified.

This illustrates how HSCs can be modified using CRISPR-Cas (e.g., C2c1) targeting a genomic locus or loci of interest in the HSC. The HSCs that are to be modified can be in vivo, i.e., in an organism, for example a human or a non-human eukaryote, e.g., animal, such as fish, e.g., zebra fish, mammal, e.g., primate, e.g., ape, chimpanzee, macaque, rodent, e.g., mouse, rabbit, rat, canine or dog, livestock (cow/bovine, sheep/ovine, goat or pig), fowl or poultry, e.g., chicken. The HSCs that are to be modified can be in vitro, i.e., outside of such an organism. And, modified HSCs can be used ex vivo, i.e., one or more HSCs of such an organism can be obtained or isolated from the organism, optionally the HSC(s) can be expanded, the HSC(s) are modified by a composition comprising a CRISPR-Cas (e.g., C2c1) that targets a genetic locus or loci in the HSC, e.g., by contacting the HSC(s) with the composition, for instance, wherein the composition comprises a particle containing the CRISPR enzyme and one or more gRNA that targets the genetic locus or loci in the HSC, such as a particle obtained or obtainable from admixing an gRNA and Cas (e.g., C2c1) protein mixture with a mixture comprising or consisting essentially of or consisting of surfactant, phospholipid, biodegradable polymer, lipoprotein and alcohol (wherein one or more gRNA targets the genetic locus or loci in the HSC), optionally expanding the resultant modified HSCs and administering to the organism the resultant modified HSCs. In some instances, the isolated or obtained HSCs can be from a first organism, such as an organism from a same species as a second organism, and the second organism can be the organism to which the resultant modified HSCs are administered, e.g., the first organism can be a donor (such as a relative as in a parent or sibling) to the second organism. Modified HSCs can have genetic modifications to address or alleviate or reduce symptoms of a disease or condition state of an individual or subject or patient. Modified HSCs, e.g., in the instance of a first organism donor to a second organism, can have genetic modifications to have the HSCs have one or more proteins e.g., surface markers or proteins more like that of the second organism. Modified HSCs can have genetic modifications to simulate a disease or condition state of an individual or subject or patient and would be re-administered to a non-human organism so as to prepare an animal model. Expansion of HSCs is within the ambit of the skilled person from this disclosure and knowledge in the art, see e.g., Lee, "Improved ex vivo expansion of adult hematopoietic stem cells by overcoming CUL4-mediated degradation of HOXB4." Blood. 2013 May 16; 121(20):4082-9. doi: 10.1182/blood-2012-09-455204. Epub 2013 Mar. 21.

As indicated to improve activity, gRNA may be pre-complexed with the Cas (e.g., C2c1) protein, before formulating the entire complex in a particle. Formulations may be made with a different molar ratio of different components known to promote delivery of nucleic acids into cells (e.g., 1,2-dioleoyl-3-trimethylammonium-propane (DOTAP), 1,2-ditetradecanoyl-sn-glycero-3-phosphocholine (DMPC), polyethylene glycol (PEG), and cholesterol). For example, DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5, DOTAP 100, DMPC 0, PEG 0, Cholesterol 0. The invention accordingly comprehends admixing gRNA, Cas (e.g., C2c1) protein and components that form a particle as well as particles from such admixing.

In a preferred embodiment, particles containing the Cas (e.g., C2c1)-gRNA complexes may be formed by mixing Cas (e.g., C2c1) protein and one or more gRNAs together, preferably at a 1:1 molar ratio, enzyme: guide RNA. Separately, the different components known to promote delivery of nucleic acids (e.g., DOTAP, DMPC, PEG, and cholesterol) are dissolved, preferably in ethanol. The two solutions are mixed together to form particles containing the Cas (e.g., C2c1)-gRNA complexes. After the particles are formed, Cas (e.g., C2c1)-gRNA complexes may be transfected into cells (e.g., HSCs). Bar coding may be applied. The particles, the Cas and/or the gRNA may be barcoded.

The invention in an embodiment comprehends a method of preparing an gRNA-and-Cas (e.g., C2c1) protein containing particle comprising admixing an gRNA and Cas (e.g., C2c1) protein mixture with a mixture comprising or consisting essentially of or consisting of surfactant, phospholipid, biodegradable polymer, lipoprotein and alcohol. An embodiment comprehends an gRNA-and-Cas (e.g., C2c1) protein containing particle from the method. The invention in an embodiment comprehends use of the particle in a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest; or a method of modifying a genomic locus of interest, or an organism or a non-human organism by manipulation of a target sequence in a genomic locus of interest, comprising contacting a cell containing the genomic locus of interest with the particle wherein the gRNA targets the genomic locus of interest. In these embodiments, the genomic locus of interest is advantageously a genomic locus in an HSC.

Considerations for Therapeutic Applications: A consideration in genome editing therapy is the choice of sequence-specific nuclease, such as a variant of a C2c1 nuclease. Each nuclease variant may possess its own unique set of strengths and weaknesses, many of which must be balanced in the context of treatment to maximize therapeutic benefit. Thus far, two therapeutic editing approaches with nucleases have shown significant promise: gene disruption and gene correction. Gene disruption involves stimulation of NHEJ to create targeted indels in genetic elements, often resulting in loss of function mutations that are beneficial to patients. In contrast, gene correction uses HDR to directly reverse a disease causing mutation, restoring function while preserving physiological regulation of the corrected element. HDR may also be used to insert a therapeutic transgene into a defined 'safe harbor' locus in the genome to recover missing gene function. For a specific editing therapy to be efficacious, a sufficiently high level of modification must be achieved in target cell populations to reverse disease symptoms. This therapeutic modification 'threshold' is determined by the fitness of edited cells following treatment and the amount of gene product necessary to reverse symptoms. With regard to fitness, editing creates three potential outcomes for treated cells relative to their unedited counterparts: increased, neutral, or decreased fitness. In the case of increased fitness, for example in the treatment of SCID-X1, modified hematopoietic progenitor cells selectively expand relative to their unedited counterparts. SCID-X1 is a disease caused by mutations in the IL2RG gene, the function of which is required for proper development of the hematopoietic lymphocyte lineage [Leonard, W. J., et al. Immunological reviews 138, 61-86 (1994); Kaushansky, K. & Williams, W. J. Williams hematology, (McGraw-Hill Medical, New York, 2010)]. In clinical trials with patients who received viral gene therapy for SCID-X1, and a rare example of a spontaneous correction of SCID-X1 mutation, corrected hematopoietic progenitor cells may be able to overcome this developmental block and expand relative to their diseased counterparts to mediate therapy [Bousso, P., et al. Proceedings of the National Academy of Sciences of the United States of America 97, 274-278 (2000); Hacein-Bey-Abina, S., et al. The New England journal of medicine 346, 1185-1193 (2002); Gaspar, H. B., et al. Lancet 364, 2181-2187 (2004)]. In this case, where edited cells possess a selective advantage, even low numbers of edited cells can be amplified through expansion, providing a therapeutic benefit to the patient. In contrast, editing for other hematopoietic diseases, like chronic granulomatous disorder (CGD), would induce no change in fitness for edited hematopoietic progenitor cells, increasing the therapeutic modification threshold. CGD is caused by mutations in genes encoding phagocytic oxidase proteins, which are normally used by neutrophils to generate reactive oxygen species that kill pathogens [Mukherjee, S. & Thrasher, A. J. Gene 525, 174-181 (2013)]. As dysfunction of these genes does not influence hematopoietic progenitor cell fitness or development, but only the ability of a mature hematopoietic cell type to fight infections, there would be likely no preferential expansion of edited cells in this disease. Indeed, no selective advantage for gene corrected cells in CGD has been observed in gene therapy trials, leading to difficulties with long-term cell engraftment [Malech, H. L., et al. Proceedings of the National Academy of Sciences of the United States of America 94, 12133-12138 (1997); Kang, H. J., et al. Molecular therapy: the journal of the American Society of Gene Therapy 19, 2092-2101 (2011)]. As such, significantly higher levels of editing would be required to treat diseases like CGD, where editing creates a neutral fitness advantage, relative to diseases where editing creates increased fitness for target cells. If editing imposes a fitness disadvantage, as would be the case for restoring function to a tumor suppressor gene in cancer cells, modified cells would be outcompeted by their diseased counterparts, causing the benefit of treatment to be low relative to editing rates. This latter class of diseases would be particularly difficult to treat with genome editing therapy.

In addition to cell fitness, the amount of gene product necessary to treat disease also influences the minimal level of therapeutic genome editing that must be achieved to reverse symptoms. Hemophilia B is one disease where a small change in gene product levels can result in significant changes in clinical outcomes. This disease is caused by mutations in the gene encoding factor IX, a protein normally secreted by the liver into the blood, where it functions as a component of the clotting cascade. Clinical severity of hemophilia B is related to the amount of factor IX activity. Whereas severe disease is associated with less than 1% of normal activity, milder forms of the diseases are associated with greater than 1% of factor IX activity [Kaushansky, K. & Williams, W. J. Williams hematology, (McGraw-Hill Medical, New York, 2010); Lofqvist, T., et al. Journal of internal medicine 241, 395-400 (1997)]. This suggests that editing therapies that can restore factor IX expression to even a small percentage of liver cells could have a large impact on clinical outcomes. A study using ZFNs to correct a mouse model of hemophilia B shortly after birth demonstrated that 3-7% correction was sufficient to reverse disease symptoms, providing preclinical evidence for this hypothesis [Li, H., et al. Nature 475, 217-221 (2011)].

Disorders where a small change in gene product levels can influence clinical outcomes and diseases where there is a fitness advantage for edited cells are ideal targets for genome editing therapy, as the therapeutic modification threshold is low enough to permit a high chance of success given the current technology. Targeting these diseases has now resulted in successes with editing therapy at the preclinical level and a phase I clinical trial. Improvements in DSB repair pathway manipulation and nuclease delivery are needed to extend these promising results to diseases with a neutral fitness advantage for edited cells, or where larger amounts of gene product are needed for treatment. Table 6 below shows some examples of applications of genome editing to therapeutic models, and the references of Table 6 below and the documents cited in those references are hereby incorporated herein by reference as if set out in full.

TABLE 6

| Disease Type | Nuclease Platform Employed | Therapeutic Strategy | References |
|---|---|---|---|
| Hemophilia B | ZFN | HDR-mediated insertion of correct gene sequence | Li, H., et al. Nature 475, 217-221 (2011) |
| SCID | ZFN | HDR-mediated insertion of correct gene sequence | Genovese, P., et al. Nature 510, 235-240 (2014) |
| Hereditary tyrosinemia | CRISPR | HDR-mediated correction of mutation in liver | Yin, H., et al. Nature Biotechnology 32, 551-553 (2014) |

Addressing each of the conditions of the foregoing table, using the CRISPR-Cas (e.g., C2c1) system to target by either HDR-mediated correction of mutation, or HDR-mediated insertion of correct gene sequence, advantageously via a delivery system as herein, e.g., a particle delivery system, is within the ambit of the skilled person from this disclosure and the knowledge in the art. Thus, an embodiment comprehends contacting a Hemophilia B, SCID (e.g., SCID-X1, ADA-SCID) or Hereditary tyrosinemia mutation-carrying HSC with an gRNA-and-Cas (e.g., C2c1) protein containing particle targeting a genomic locus of interest as to Hemophilia B, SCID (e.g., SCID-X1, ADA-SCID) or Hereditary tyrosinemia (e.g., as in Li, Genovese or Yin). The particle also can contain a suitable HDR template to correct the mutation; or the HSC can be contacted with a second particle or a vector that contains or delivers the HDR template. In this regard, it is mentioned that Hemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications. With the knowledge in the art and the teachings in this disclosure, the skilled person can correct HSCs as to Hemophilia B using a CRISPR-Cas (e.g., C2c1) system that targets and corrects the mutation (X-linked recessive disorder caused by loss-of-function mutations in the gene encoding Factor IX) (e.g., with a suitable HDR template that delivers a coding sequence for Factor IX); specifically, the gRNA can target mutation that give rise to Hemophilia B, and the HDR can provide coding for proper expression of Factor IX. An gRNA that targets the mutation-and-Cas (e.g., C2c1) protein containing particle is contacted with HSCs carrying the mutation. The particle also can contain a suitable HDR template to correct the mutation for proper expression of Factor IX; or the HSC can be contacted with a second particle or a vector that contains or delivers the HDR template. The so contacted cells can be administered; and optionally treated/expanded; cf. Cartier, discussed herein.

In Cartier, "MINI-SYMPOSIUM: X-Linked Adrenoleukodystrophypa, Hematopoietic Stem Cell Transplantation and Hematopoietic Stem Cell Gene Therapy in X-Linked Adrenoleukodystrophy," Brain Pathology 20 (2010) 857-862, incorporated herein by reference along with the documents it cites, as if set out in full, there is recognition that allogeneic hematopoietic stem cell transplantation (HSCT) was utilized to deliver normal lysosomal enzyme to the brain of a patient with Hurler's disease, and a discussion of HSC gene therapy to treat ALD. In two patients, peripheral CD34+ cells were collected after granulocyte-colony stimulating factor (G-CSF) mobilization and transduced with a myeloproliferative sarcoma virus enhancer, negative control region deleted, dl587rev primer binding site substituted (MND)-ALD lentiviral vector. CD34+ cells from the patients were transduced with the MND-ALD vector during 16 h in the presence of cytokines at low concentrations. Transduced CD34+ cells were frozen after transduction to perform on 5% of cells various safety tests that included, in particular, three replication-competent lentivirus (RCL) assays. Transduction efficacy of CD34+ cells ranged from 35% to 50% with a mean number of lentiviral integrated copy between 0.65 and 0.70. After the thawing of transduced CD34+ cells, the patients were reinfused with more than 4.106 transduced CD34+ cells/kg following full myeloablation with busulfan and cyclophos-phamide. The patient's HSCs were ablated to favor engraftment of the gene-corrected HSCs. Hematological recovery occurred between days 13 and 15 for the two patients. Nearly complete immunological recovery occurred at 12 months for the first patient, and at 9 months for the second patient. In contrast to using lentivirus, with the knowledge in the art and the teachings in this disclosure, the skilled person can correct HSCs as to ALD using a CRISPR-Cas (C2c1) system that targets and corrects the mutation (e.g., with a suitable HDR template); specifically, the gRNA can target mutations in ABCD1, a gene located on the X chromosome that codes for ALD, a peroxisomal membrane transporter protein, and the HDR can provide coding for proper expression of the protein. An gRNA that targets the mutation-and-Cas (C2c1) protein containing particle is contacted with HSCs, e.g., CD34+ cells carrying the mutation as in Cartier. The particle also can contain a suitable HDR template to correct the mutation for expression of the peroxisomal membrane transporter protein; or the HSC can be contacted with a second particle or a vector that contains or delivers the HDR template. The so contacted cells optionally can be treated as in Cartier. The so contacted cells can be administered as in Cartier.

Mention is made of WO 2015/148860, through the teachings herein the invention comprehends methods and materials of these documents applied in conjunction with the teachings herein. In an aspect of blood-related disease gene therapy, methods and compositions for treating beta thalassemia may be adapted to the CRISPR-Cas system of the present invention (see, e.g., WO 2015/148860). In an embodiment, WO 2015/148860 involves the treatment or prevention of beta thalassemia, or its symptoms, e.g., by altering the gene for B-cell CLL/lymphoma 11A (BCL11A). The BCL11A gene is also known as B-cell CLL/lymphoma 11A, BCL11A-L, BCL11A-S, BCL11AXL, CTIP 1, HBFQTL5 and ZNF. BCL11A encodes a zinc-finger protein that is involved in the regulation of globin gene expression. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating beta thalassemia disease phenotypes.

Mention is also made of WO 2015/148863 and through the teachings herein the invention comprehends methods and materials of these documents which may be adapted to the CRISPR-Cas system of the present invention. In an aspect of treating and preventing sickle cell disease, which is an inherited hematologic disease, WO 2015/148863 comprehends altering the BCL11A gene. By altering the BCL11A gene (e.g., one or both alleles of the BCL11A gene), the levels of gamma globin can be increased. Gamma globin can replace beta globin in the hemoglobin complex and effectively carry oxygen to tissues, thereby ameliorating sickle cell disease phenotypes.

In an aspect of the invention, methods and compositions which involve editing a target nucleic acid sequence, or modulating expression of a target nucleic acid sequence, and applications thereof in connection with cancer immunotherapy are comprehended by adapting the CRISPR-Cas system of the present invention. Reference is made to the application of gene therapy in WO 2015/161276 which involves methods and compositions which can be used to affect T-cell proliferation, survival and/or function by altering one or more T-cell expressed genes, e.g., one or more of FAS, BID, CTLA4, PDCD1, CBLB, PTPN6, TRAC and/or TRBC genes. In a related aspect, T-cell proliferation can be affected by altering one or more T-cell expressed genes, e.g., the CBLB and/or PTPN6 gene, FAS and/or BID gene, CTLA4 and/or PDCDI and/or TRAC and/or TRBC gene.

Chimeric antigen receptor (CAR)19 T-cells exhibit antileukemic effects in patient malignancies. However, leukemia patients often do not have enough T-cells to collect, meaning that treatment must involve modified T cells from donors. Accordingly, there is interest in establishing a bank of donor T-cells. Qasim et al. ("First Clinical Application of Talen Engineered Universal CAR19 T Cells in B-ALL" ASH 57th Annual Meeting and Exposition, Dec. 5-8, 2015, Abstract 2046) (ash.confex.com/ash/2015/webprogram/Paper81653.html published online November 2015) discusses modifying CAR19 T cells to eliminate the risk of graft-versus-host disease through the disruption of T-cell receptor expression and CD52 targeting. Furthermore, CD52 cells were targeted such that they became insensitive to Alemtuzumab, and thus allowed Alemtuzumab to prevent host-mediated rejection of human leukocyte antigen (HLA) mismatched CAR19 T-cells. Investigators used third generation self-inactivating lentiviral vector encoding a 4g7 CAR19 (CD19 scFv-4-1BB-CD3ζ) linked to RQR8, then electroporated cells with two pairs of TALEN mRNA for multiplex targeting for both the T-cell receptor (TCR) alpha constant chain locus and the CD52 gene locus. Cells which were still expressing TCR following ex vivo expansion were depleted using CliniMacs α/β TCR depletion, yielding a T-cell product (UCART19) with <1% TCR expression, 85% of which expressed CAR19, and 64% becoming CD52 negative. The modified CAR19 T cells were administered to treat a patient's relapsed acute lymphoblastic leukemia. The teachings provided herein provide effective methods for providing modified hematopoietic stem cells and progeny thereof, including, but not limited to, cells of the myeloid and lymphoid lineages of blood, including T cells, B cells, monocytes, macrophages, neutrophils, basophils, eosinophils, erythrocytes, dendritic cells, and megakaryocytes or platelets, and natural killer cells and their precursors and progenitors. Such cells can be modified by knocking out, knocking in, or otherwise modulating targets, for example to remove or modulate CD52 as described above, and other targets, such as, without limitation, CXCR4, and PD-1. Thus compositions, cells, and method of the invention can be used to modulate immune responses and to treat, without limitation, malignancies, viral infections, and immune disorders, in conjunction with modification of administration of T cells or other cells to patients.

Mention is made of WO 2015/148670 and through the teachings herein the invention comprehends methods and materials of this document applied in conjunction with the teachings herein. In an aspect of gene therapy, methods and compositions for editing of a target sequence related to or in connection with Human Immunodeficiency Virus (HIV) and Acquired Immunodeficiency Syndrome (AIDS) are comprehended. In a related aspect, the invention described herein comprehends prevention and treatment of HIV infection and AIDS, by introducing one or more mutations in the gene for C-C chemokine receptor type 5 (CCR5). The CCR5 gene is also known as CKR5, CCR-5, CD195, CKR-5, CCCKR5, CMKBR5, IDDM22, and CC-CKR-5. In a further aspect, the invention described herein comprehends prevention or reduction of HIV infection and/or prevention or reduction of the ability for HIV to enter host cells, e.g., in subjects who are already infected. Exemplary host cells for HIV include, but are not limited to, CD4 cells, T cells, gut associated lymphatic tissue (GALT), macrophages, dendritic cells, myeloid precursor cell, and microglia. Viral entry into the host cells requires interaction of the viral glycoproteins gp41 and gp120 with both the CD4 receptor and a co-receptor, e.g., CCR5. If a co-receptor, e.g., CCR5, is not present on the surface of the host cells, the virus cannot bind and enter the host cells. The progress of the disease is thus impeded. By knocking out or knocking down CCR5 in the host cells, e.g., by introducing a protective mutation (such as a CCR5 delta 32 mutation), entry of the HIV virus into the host cells is prevented.

X-linked Chronic granulomatous disease (CGD) is a hereditary disorder of host defense due to absent or decreased activity of phagocyte NADPH oxidase. Using a CRISPR-Cas (C2c1) system that targets and corrects the mutation (absent or decreased activity of phagocyte NADPH oxidase) (e.g., with a suitable HDR template that delivers a coding sequence for phagocyte NADPH oxidase); specifically, the gRNA can target mutation that gives rise to CGD (deficient phagocyte NADPH oxidase), and the HDR can provide coding for proper expression of phagocyte NADPH oxidase. An gRNA that targets the mutation-and-Cas (C2c1) protein containing particle is contacted with HSCs carrying the mutation. The particle also can contain a suitable HDR template to correct the mutation for proper expression of phagocyte NADPH oxidase; or the HSC can be contacted with a second particle or a vector that contains or delivers the HDR template. The so contacted cells can be administered and optionally treated/expanded; cf. Cartier.

Fanconi anemia: Mutations in at least 15 genes (FANCA, FANCB, FANCC, FANCD1/BRCA2, FANCD2, FANCE, FANCF, FANCG, FANCI, FANCJ/BACH1/BRIP1, FANCL/PHF9/POG, FANCM, FANCN/PALB2, FANCO/Rad51C, and FANCP/SLX4/BTBD12) can cause Fanconi anemia. Proteins produced from these genes are involved in a cell process known as the FA pathway. The FA pathway is turned on (activated) when the process of making new copies of DNA, called DNA replication, is blocked due to DNA damage. The FA pathway sends certain proteins to the area of damage, which trigger DNA repair so DNA replication can continue. The FA pathway is particularly responsive to a certain type of DNA damage known as interstrand cross-links (ICLs). ICLs occur when two DNA building blocks (nucleotides) on opposite strands of DNA are abnormally attached or linked together, which stops the process of DNA replication. ICLs can be caused by a buildup of toxic substances produced in the body or by treatment with certain cancer therapy drugs. Eight proteins associated with Fanconi anemia group together to form a complex known as the FA core complex. The FA core complex activates two proteins, called FANCD2 and FANCI. The activation of these two proteins brings DNA repair proteins to the area of the ICL so the cross-link can be removed and DNA replication can continue. More in particular, the FA core complex is a nuclear multiprotein complex consisting of FANCA, FANCB, FANCC, FANCE, FANCF, FANCG, FANCL, and FANCM, functions as an E3 ubiquitin ligase and mediates the activation of the ID complex, which is a heterodimer composed of FANCD2 and FANCI. Once monoubiquitinated, it interacts with classical tumor suppressors downstream of the FA pathway including FANCD1/BRCA2, FANCN/PALB2, FANCJ/BRIP1, and FANCO/Rad51C and thereby contributes to DNA repair via homologous recombination (HR). Eighty to 90 percent of FA cases are due to mutations in one of three genes, FANCA, FANCC, and FANCG. These genes provide instructions for producing components of the FA core complex. Mutations in such genes associated with the FA core complex will cause the complex to be nonfunctional and disrupt the entire FA pathway. As a result, DNA damage is not repaired efficiently and ICLs build up over time. Geiselhart, "Review Article, Disrupted Signaling through the Fanconi Anemia Pathway Leads to Dysfunctional Hematopoietic Stem Cell Biology: Underlying Mechanisms and Potential Therapeutic Strategies," Anemia Volume 2012 (2012), Article ID 265790, dx.doi.org/10.1155/2012/265790 discussed FA and an animal experiment involving intrafemoral injection of a lentivirus encoding the FANCC gene resulting in correction of HSCs in vivo. Using a CRISPR-Cas (C2c1) system that targets one or more of the mutations associated with FA, for instance a CRISPR-Cas (C2c1) system having gRNA(s) and HDR template(s) that respectively targets one or more of the mutations of FANCA, FANCC, or FANCG that give rise to FA and provide corrective expression of one or more of FANCA, FANCC or FANCG; the gRNA can target a mutation as to FANCC, and the HDR can provide coding for proper expression of FANCC. An gRNA that targets the mutation(s) (e.g., one or more involved in FA, such as mutation(s) as to any one or more of FANCA, FANCC or FANCG)-and-Cas (C2c1) protein containing particle is contacted with HSCs carrying the mutation(s). The particle also can contain a suitable HDR template(s) to correct the mutation for proper expression of one or more of the proteins involved in FA, such as any one or more of FANCA, FANCC or FANCG; or the HSC can be contacted with a second particle or a vector that contains or delivers the HDR template. The so contacted cells can be administered and optionally treated/expanded; cf. Cartier.

The particle in the herein discussion (e.g., as to containing gRNA(s) and Cas (C2c1), optionally HDR template(s), or HDR template(s); for instance as to Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, Immunodeficiency disorder, Hematologic condition, or genetic lysosomal storage disease) is advantageously obtained or obtainable from admixing an gRNA(s) and Cas (C2c1) protein mixture (optionally containing HDR template(s) or such mixture only containing HDR template(s) when separate particles as to template(s) is desired) with a mixture comprising or consisting essentially of or consisting of surfactant, phospholipid, biodegradable polymer, lipoprotein and alcohol (wherein one or more gRNA targets the genetic locus or loci in the HSC).

Indeed, the invention is especially suited for treating hematopoietic genetic disorders with genome editing, and immunodeficiency disorders, such as genetic immunodeficiency disorders, especially through using the particle technology herein discussed. Genetic immunodeficiencies are diseases where genome editing interventions of the instant invention can be successful. The reasons include that hematopoietic cells, of which immune cells are a subset, are therapeutically accessible. They can be removed from the body and transplanted autologously or allogenically. Further, certain genetic immunodeficiencies, e.g., severe combined immunodeficiency (SCID), create a proliferative disadvantage for immune cells. Correction of genetic lesions causing SCID by rare, spontaneous 'reverse' mutations indicates that correcting even one lymphocyte progenitor may be sufficient to recover immune function in patients . . . / . . . / . . . /Users/t_kowalski/AppData/Local/Microsoft/Windows/Temporary Internet Files/Content.Outlook/GA8VY8LK/Treating SCID for Ellen.docx—_ENREF_1 See Bousso, P., et al. Diversity, functionality, and stability of the T cell repertoire derived in vivo from a single human T cell precursor. Proceedings of the National Academy of Sciences of the United States of America 97, 274-278 (2000). The selective advantage for edited cells allows for even lower levels of editing to result in a therapeutic effect. This effect of the instant invention can be seen in SCID, Wiskott-Aldrich Syndrome, and the other conditions mentioned herein, including other genetic hematopoietic disorders such as alpha- and beta-thalassemia, where hemoglobin deficiencies negatively affect the fitness of erythroid progenitors.

The activity of NHEJ and HDR DSB repair varies significantly by cell type and cell state. NHEJ is not highly regulated by the cell cycle and is efficient across cell types, allowing for high levels of gene disruption in accessible target cell populations. In contrast, HDR acts primarily during S/G2 phase, and is therefore restricted to cells that are actively dividing, limiting treatments that require precise genome modifications to mitotic cells [Ciccia, A. & Elledge, S. J. Molecular cell 40, 179-204 (2010); Chapman, J. R., et al. Molecular cell 47, 497-510 (2012)]. Notably, the CRISPR-C2c1 system comprising a C2c1 protein generates staggering cuts at the target site. Therefore, cleavage, modification and/or repair of target sequences in this invention may be HDR dependent or independent. In particular embodiments, the CRISPR-C2c1 system introduces staggered DSB repair via NHEJ. In certain particular embodiments, the CRISPR-C2c1 system in this invention introduces staggered DSB repair via NHEJ in non-dividing cells such as neurons.

The efficiency of correction via HDR may be controlled by the epigenetic state or sequence of the targeted locus, or the specific repair template configuration (single vs. double stranded, long vs. short homology arms) used [Hacein-Bey-Abina, S., et al. The New England journal of medicine 346, 1185-1193 (2002); Gaspar, H. B., et al. Lancet 364, 2181-2187 (2004); Beumer, K. J., et al. G3 (2013)]. The relative activity of NHEJ and HDR machineries in target cells may also affect gene correction efficiency, as these pathways may compete to resolve DSBs [Beumer, K. J., et al. Proceedings of the National Academy of Sciences of the United States of America 105, 19821-19826 (2008)]. HDR also imposes a delivery challenge not seen with NHEJ strategies, as it requires the concurrent delivery of nucleases and repair templates. In practice, these constraints have so far led to low levels of HDR in therapeutically relevant cell types. Clinical translation has therefore largely focused on NHEJ strategies to treat disease, although proof-of-concept preclinical HDR treatments have now been described for mouse models of hemophilia B and hereditary tyrosinemia [Li, H., et al. Nature 475, 217-221 (2011); Yin, H., et al. Nature biotechnology 32, 551-553 (2014)].

Any given genome editing application may comprise combinations of proteins, small RNA molecules, and/or repair templates, making delivery of these multiple parts substantially more challenging than small molecule therapeutics. Two main strategies for delivery of genome editing tools have been developed: ex vivo and in vivo. In ex vivo treatments, diseased cells are removed from the body, edited and then transplanted back into the patient. Ex vivo editing has the advantage of allowing the target cell population to be well defined and the specific dosage of therapeutic molecules delivered to cells to be specified. The latter consideration may be particularly important when off-target modifications are a concern, as titrating the amount of nuclease may decrease such mutations (Hsu et al., 2013). Another advantage of ex vivo approaches is the typically high editing rates that can be achieved, due to the development of efficient delivery systems for proteins and nucleic acids into cells in culture for research and gene therapy applications.

There may be drawbacks with ex vivo approaches that limit application to a small number of diseases. For instance, target cells must be capable of surviving manipulation outside the body. For many tissues, like the brain, culturing cells outside the body is a major challenge, because cells either fail to survive, or lose properties necessary for their function in vivo. Thus, in view of this disclosure and the knowledge in the art, ex vivo therapy as to tissues with adult stem cell populations amenable to ex vivo culture and manipulation, such as the hematopoietic system, by the CRISPR-Cas (C2c1) system are enabled. [Bunn, H. F. & Aster, J. Pathophysiology of blood disorders, (McGraw-Hill, New York, 2011)]

In vivo genome editing involves direct delivery of editing systems to cell types in their native tissues. In vivo editing allows diseases in which the affected cell population is not amenable to ex vivo manipulation to be treated. Furthermore, delivering nucleases to cells in situ allows for the treatment of multiple tissue and cell types. These properties probably allow in vivo treatment to be applied to a wider range of diseases than ex vivo therapies.

To date, in vivo editing has largely been achieved through the use of viral vectors with defined, tissue-specific tropism. Such vectors are currently limited in terms of cargo carrying capacity and tropism, restricting this mode of therapy to organ systems where transduction with clinically useful vectors is efficient, such as the liver, muscle and eye [Kotterman, M. A. & Schaffer, D. V. Nature reviews. Genetics 15, 445-451 (2014); Nguyen, T. H. & Ferry, N. Gene therapy 11 Suppl 1, S76-84 (2004); Boye, S. E., et al. Molecular therapy: the journal of the American Society of Gene Therapy 21, 509-519 (2013)].

A potential barrier for in vivo delivery is the immune response that may be created in response to the large amounts of virus necessary for treatment, but this phenomenon is not unique to genome editing and is observed with other virus based gene therapies [Bessis, N., et al. Gene therapy 11 Suppl 1, S10-17 (2004)]. It is also possible that peptides from editing nucleases themselves are presented on MHC Class I molecules to stimulate an immune response, although there is little evidence to support this happening at the preclinical level. Another major difficulty with this mode of therapy is controlling the distribution and consequently the dosage of genome editing nucleases in vivo, leading to off-target mutation profiles that may be difficult to predict. However, in view of this disclosure and the knowledge in the art, including the use of virus- and particle-based therapies being used in the treatment of cancers, in vivo modification of HSCs, for instance by delivery by either particle or virus, is within the ambit of the skilled person.

Ex Vivo Editing Therapy: The long standing clinical expertise with the purification, culture and transplantation of hematopoietic cells has made diseases affecting the blood system such as SCID, Fanconi anemia, Wiskott-Aldrich syndrome and sickle cell anemia the focus of ex vivo editing therapy. Another reason to focus on hematopoietic cells is that, thanks to previous efforts to design gene therapy for blood disorders, delivery systems of relatively high efficiency already exist. With these advantages, this mode of therapy can be applied to diseases where edited cells possess a fitness advantage, so that a small number of engrafted, edited cells can expand and treat disease. One such disease is HIV, where infection results in a fitness disadvantage to CD4+ T cells.

Ex vivo editing therapy has been recently extended to include gene correction strategies. The barriers to HDR ex vivo were overcome in a recent paper from Genovese and colleagues, who achieved gene correction of a mutated IL2RG gene in hematopoietic stem cells (HSCs) obtained from a patient suffering from SCID-X1 [Genovese, P., et al. Nature 510, 235-240 (2014)]. Genovese et. al. accomplished gene correction in HSCs using a multimodal strategy. First, HSCs were transduced using integration-deficient lentivirus containing an HDR template encoding a therapeutic cDNA for IL2RG. Following transduction, cells were electroporated with mRNA encoding ZFNs targeting a mutational hotspot in IL2RG to stimulate HDR based gene correction. To increase HDR rates, culture conditions were optimized with small molecules to encourage HSC division. With optimized culture conditions, nucleases and HDR templates, gene corrected HSCs from the SCID-X1 patient were obtained in culture at therapeutically relevant rates. HSCs from unaffected individuals that underwent the same gene correction procedure could sustain long-term hematopoiesis in mice, the gold standard for HSC function. HSCs are capable of giving rise to all hematopoietic cell types and can be autologously transplanted, making them an extremely valuable cell population for all hematopoietic genetic disorders [Weissman, I. L. & Shizuru, J. A. Blood 112, 3543-3553 (2008)]. Gene corrected HSCs could, in principle, be used to treat a wide range of genetic blood disorders making this study an exciting breakthrough for therapeutic genome editing.

In Vivo Editing Therapy: In vivo editing can be used advantageously from this disclosure and the knowledge in the art. For organ systems where delivery is efficient, there have already been a number of exciting preclinical therapeutic successes. The first example of successful in vivo editing therapy was demonstrated in a mouse model of hemophilia B [Li, H., et al. Nature 475, 217-221 (2011)]. As noted earlier, hemophilia B is an X-linked recessive disorder caused by loss-of-function mutations in the gene encoding Factor IX, a crucial component of the clotting cascade. Recovering Factor IX activity to above 1% of its levels in severely affected individuals can transform the disease into a significantly milder form, as infusion of recombinant Factor IX into such patients prophylactically from a young age to achieve such levels largely ameliorates clinical complications [Lofqvist, T., et al. Journal of internal medicine 241, 395-400 (1997)]. Thus, only low levels of HDR gene correction are necessary to change clinical outcomes for patients. In addition, Factor IX is synthesized and secreted by the liver, an organ that can be transduced efficiently by viral vectors encoding editing systems.

Using hepatotropic adeno-associated viral (AAV) serotypes encoding ZFNs and a corrective HDR template, up to 7% gene correction of a mutated, humanized Factor IX gene in the murine liver was achieved [Li, H., et al. Nature 475, 217-221 (2011)]. This resulted in improvement of clot formation kinetics, a measure of the function of the clotting cascade, demonstrating for the first time that in vivo editing therapy is not only feasible, but also efficacious. As discussed herein, the skilled person is positioned from the teachings herein and the knowledge in the art, e.g., Li to address hemophilia B with a particle-containing HDR template and a CRISPR-Cas (C2c1) system that targets the mutation of the X-linked recessive disorder to reverse the loss-of-function mutation.

Building on this study, other groups have recently used in vivo genome editing of the liver with CRISPR-Cas to successfully treat a mouse model of hereditary tyrosinemia and to create mutations that provide protection against cardiovascular disease. These two distinct applications demonstrate the versatility of this approach for disorders that involve hepatic dysfunction [Yin, H., et al. Nature biotechnology 32, 551-553 (2014); Ding, Q., et al. Circulation research 115, 488-492 (2014)]. Application of in vivo editing to other organ systems are necessary to prove that this strategy is widely applicable. Currently, efforts to optimize both viral and non-viral vectors are underway to expand the range of disorders that can be treated with this mode of therapy [Kotterman, M. A. & Schaffer, D. V. Nature reviews. Genetics 15, 445-451 (2014); Yin, H., et al. Nature reviews. Genetics 15, 541-555 (2014)]. As discussed herein, the skilled person is positioned from the teachings herein and the knowledge in the art, e.g., Yin to address hereditary tyrosinemia with a particle-containing HDR template and a CRISPR-Cas (C2c1) system that targets the mutation.

Targeted deletion, therapeutic applications: Targeted deletion of genes may be preferred. Preferred are, therefore, genes involved in immunodeficiency disorder, hematologic condition, or genetic lysosomal storage disease, e.g., Hemophilia B, SCID, SCID-X1, ADA-SCID, Hereditary tyrosinemia, β-thalassemia, X-linked CGD, Wiskott-Aldrich syndrome, Fanconi anemia, adrenoleukodystrophy (ALD), metachromatic leukodystrophy (MLD), HIV/AIDS, other metabolic disorders, genes encoding mis-folded proteins involved in diseases, genes leading to loss-of-function involved in diseases; generally, mutations that can be targeted in an HSC, using any herein-discussed delivery system, with the particle system considered advantageous.

In the present invention, the immunogenicity of the CRISPR enzyme in particular may be reduced following the approach first set out in Tangri et al. with respect to erythropoietin and subsequently developed. Accordingly, directed evolution or rational design may be used to reduce the immunogenicity of the CRISPR enzyme (for instance a C2c1) in the host species (human or other species).

Genome editing: The CRISPR/Cas (C2c1) systems of the present invention can be used to correct genetic mutations that were previously attempted with limited success using TALEN and ZFN and lentiviruses, including as herein discussed; see also WO2013163628. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Treating Disease of the Brain, Central Nervous and Immune Systems

The present invention also contemplates delivering the CRISPR-Cas system to the brain or neurons. In some embodiments, the CRISPR-Cas system comprises a C2c1 protein. In some embodiments, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In preferred embodiments, the CRISPR-C2c1 system introduces a template DNA sequence at the staggered DSB via HR or NHEJ, preferably NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene. For example, RNA interference (RNAi) offers therapeutic potential for this disorder by reducing the expression of HTT, the disease-causing gene of Huntington's disease (see, e.g., McBride et al., Molecular Therapy vol. 19 no. 12 Dec. 2011, pp. 2152-2162), therefore Applicant postulates that it may be used/and or adapted to the CRISPR-Cas system. The CRISPR-Cas system may be generated using an algorithm to reduce the off-targeting potential of antisense sequences. The CRISPR-Cas sequences may target either a sequence in exon 52 of mouse, rhesus or human huntingtin and expressed in a viral vector, such as AAV. Animals, including humans, may be injected with about three microinjections per hemisphere (six injections total): the first 1 mm rostral to the anterior commissure (12 μl) and the two remaining injections (12 μl and 10 μl, respectively) spaced 3 and 6 mm caudal to the first injection with 1e12 vg/ml of AAV at a rate of about 1 μl/minute, and the needle was left in place for an additional 5 minutes to allow the injectate to diffuse from the needle tip.

DiFiglia et al. (PNAS, Oct. 23, 2007, vol. 104, no. 43, 17204-17209) observed that single administration into the adult striatum of an siRNA targeting Htt can silence mutant Htt, attenuate neuronal pathology, and delay the abnormal behavioral phenotype observed in a rapid-onset, viral transgenic mouse model of HD. DiFiglia injected mice intrastriatally with 2 μl of Cy3-labeled cc-siRNA-Htt or unconjugated siRNA-Htt at 10 μM. A similar dosage of CRISPR Cas targeted to Htt may be contemplated for humans in the present invention, for example, about 5-10 ml of 10 μM CRISPR Cas targeted to Htt may be injected intrastriatally.

In another example, Boudreau et al. (Molecular Therapy vol. 17 no. 6 Jun. 2009) injects 5 μl of recombinant AAV serotype 2/1 vectors expressing htt-specific RNAi virus (at $4\times10^{12}$ viral genomes/ml) into the striatum. A similar dosage of CRISPR Cas targeted to Htt may be contemplated for humans in the present invention, for example, about 10-20 ml of $4\times10^{12}$ viral genomes/ml) CRISPR Cas targeted to Htt may be injected intrastriatally.

In another example, a CRISPR Cas targeted to HTT may be administered continuously (see, e.g., Yu et al., Cell 150, 895-908, Aug. 31, 2012). Yu et al. utilizes osmotic pumps delivering 0.25 ml/hr (Model 2004) to deliver 300 mg/day of ss-siRNA or phosphate-buffered saline (PBS) (Sigma Aldrich) for 28 days, and pumps designed to deliver 0.5 μl/hr (Model 2002) were used to deliver 75 mg/day of the positive control MOE ASO for 14 days. Pumps (Durect Corporation) were filled with ss-siRNA or MOE diluted in sterile PBS and then incubated at 37 C for 24 or 48 (Model 2004) hours prior to implantation. Mice were anesthetized with 2.5% isoflurane, and a midline incision was made at the base of the skull. Using stereotaxic guides, a cannula was implanted into the right lateral ventricle and secured with Loctite adhesive. A catheter attached to an Alzet osmotic mini pump was attached to the cannula, and the pump was placed subcutaneously in the midscapular area. The incision was closed with 5.0 nylon sutures. A similar dosage of CRISPR Cas targeted to Htt may be contemplated for humans in the present invention, for example, about 500 to 1000 g/day CRISPR Cas targeted to Htt may be administered.

In another example of continuous infusion, Stiles et al. (Experimental Neurology 233 (2012) 463-471) implanted an intraparenchymal catheter with a titanium needle tip into the right putamen. The catheter was connected to a SynchroMed® II Pump (Medtronic Neurological, Minneapolis, MN) subcutaneously implanted in the abdomen. After a 7 day infusion of phosphate buffered saline at 6 μL/day, pumps were re-filled with test article and programmed for continuous delivery for 7 days. About 2.3 to 11.52 mg/d of siRNA were infused at varying infusion rates of about 0.1 to 0.5 μL/min. A similar dosage of CRISPR Cas targeted to Htt may be contemplated for humans in the present invention, for example, about 20 to 200 mg/day CRISPR Cas targeted to Htt may be administered. In another example, the methods of US Patent Publication No. 20130253040 assigned to Sangamo may also be adapted from TALES to the nucleic acid-targeting system of the present invention for treating Huntington's Disease.

In another example, the methods of US Patent Publication No. 20130253040 (WO2013130824) assigned to Sangamo may also be adapted from TALES to the CRISPR Cas system of the present invention for treating Huntington's Disease.

WO2015089354 A1 in the name of The Broad Institute et al., hereby incorporated by reference, describes targets for Huntington's Disease (HP). Possible target genes of CRISPR complex in regard to Huntington's Disease: PRKCE; IGF1; EP300; RCOR1; PRKCZ; HDAC4; and TGM2. Accordingly, one or more of PRKCE; IGF1; EP300; RCOR1; PRKCZ; HDAC4; and TGM2 may be selected as targets for Huntington's Disease in some embodiments of the present invention.

Other trinucleotide repeat disorders may include any of the following: Category I includes Huntington's disease (HD) and the spinocerebellar ataxias; Category II expansions are phenotypically diverse with heterogeneous expansions that are generally small in magnitude, but also found in the exons of genes; and Category III includes fragile X syndrome, myotonic dystrophy, two of the spinocerebellar ataxias, juvenile myoclonic epilepsy, and Friedreich's ataxia.

A further aspect of the invention relates to utilizing the CRISPR-Cas system for correcting defects in the EMP2A and EMP2B genes that have been identified to be associated with Lafora disease. Lafora disease is an autosomal recessive condition which is characterized by progressive myoclonus epilepsy which may start as epileptic seizures in adolescence. A few cases of the disease may be caused by mutations in genes yet to be identified. The disease causes seizures, muscle spasms, difficulty walking, dementia, and eventually death. There is currently no therapy that has proven effective against disease progression. Other genetic abnormalities associated with epilepsy may also be targeted by the CRISPR-Cas system and the underlying genetics is further described in Genetics of Epilepsy and Genetic Epilepsies, edited by Giuliano Avanzini, Jeffrey L. Noebels, Mariani Foundation Paediatric Neurology:20; 2009.

The methods of US Patent Publication No. 20110158957 assigned to Sangamo BioSciences, Inc. involved in inactivating T cell receptor (TCR) genes may also be modified to the CRISPR Cas system of the present invention. In another example, the methods of US Patent Publication No. 20100311124 assigned to Sangamo BioSciences, Inc. and US Patent Publication No. 20110225664 assigned to Cellectis, which are both involved in inactivating glutamine synthetase gene expression genes may also be modified to the CRISPR Cas system of the present invention.

Delivery options for the brain include encapsulation of CRISPR enzyme and guide RNA in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors containing CRISPR enzyme and guide RNA. For instance, Xia C F and Boado R J, Pardridge W M ("Antibody-mediated targeting of siRNA via the human insulin receptor using avidin-biotin technology." Mol Pharm. 2009 May-June; 6(3):747-51. doi: 10.1021/mp800194) describes how delivery of short interfering RNA (siRNA) to cells in culture, and in vivo, is possible with combined use of a receptor-specific monoclonal antibody (mAb) and avidin-biotin technology. The authors also report that because the bond between the targeting mAb and the siRNA is stable with avidin-biotin technology, and RNAi effects at distant sites such as brain are observed in vivo following an intravenous administration of the targeted siRNA.

Zhang et al. (Mol Ther. 2003 January; 7(1):11-8.) describe how expression plasmids encoding reporters such as luciferase were encapsulated in the interior of an "artificial virus" comprised of an 85 nm pegylated immunoliposome, which was targeted to the rhesus monkey brain in vivo with a monoclonal antibody (MAb) to the human insulin receptor (HIR). The HIRMAb enables the liposome carrying the exogenous gene to undergo transcytosis across the blood-brain barrier and endocytosis across the neuronal plasma membrane following intravenous injection. The level of luciferase gene expression in the brain was 50-fold higher in the rhesus monkey as compared to the rat. Widespread neuronal expression of the beta-galactosidase gene in primate brain was demonstrated by both histochemistry and confocal microscopy. The authors indicate that this approach makes feasible reversible adult transgenics in 24 hours. Accordingly, the use of immunoliposome is preferred. These may be used in conjunction with antibodies to target specific tissues or cell surface proteins.

Alzheimer's Disease

US Patent Publication No. 20110023153, describes use of zinc finger nucleases to genetically modify cells, animals and proteins associated with Alzheimer's Disease. Once modified, cells and animals may be further tested using known methods to study the effects of the targeted mutations on the development and/or progression of AD using measures commonly used in the study of AD—such as, without limitation, learning and memory, anxiety, depression, addiction, and sensory motor functions as well as assays that measure behavioral, functional, pathological, metabolic and biochemical function.

The present disclosure comprises editing of any chromosomal sequences that encode proteins associated with AD.

In some embodiments, the system disclosed in this invention comprises a C2c1-CRISPR system. In some embodiments, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation to AD related genes. In another particular embodiment, the CRISPR-C2c1 system introduces a single nucleotide modification to the transcript of AD related genes. The AD-related proteins are typically selected based on an experimental association of the AD-related protein to an AD disorder. For example, the production rate or circulating concentration of an AD-related protein may be elevated or depressed in a population having an AD disorder relative to a population lacking the AD disorder. Differences in protein levels may be assessed using proteomic techniques including, but not limited to, Western blot, immunohistochemical staining, enzyme linked immunosorbent assay (ELISA), and mass spectrometry. Alternatively, the AD-related proteins may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR).

Examples of Alzheimer's disease associated proteins may include the very low density lipoprotein receptor protein (VLDLR) encoded by the VLDLR gene, the ubiquitin-like modifier activating enzyme 1 (UBA1) encoded by the UBA1 gene, or the NEDD8-activating enzyme E1 catalytic subunit protein (UBE1C) encoded by the UBA3 gene, for example.

By way of non-limiting example, proteins associated with AD include, but are not limited to, the proteins listed as follows: Chromosomal Sequence Encoded Protein, ALAS2 Delta-aminolevulinate synthase 2 (ALAS2), ABCA1 ATP-binding cassette transporter (ABCA1), ACE Angiotensin I-converting enzyme (ACE), APOE Apolipoprotein E precursor (APOE), APP amyloid precursor protein (APP), AQP1 aquaporin 1 protein (AQP1), BIN1 Myc box-dependent-interacting protein 1 or bridging integrator 1 protein (BIN1), BDNF brain-derived neurotrophic factor (BDNF), BTNL8 Butyrophilin-like protein 8 (BTNL8), C1ORF49 chromosome 1 open reading frame 49 CDH4 Cadherin-4 CHRNB2 Neuronal acetylcholine receptor subunit beta-2, CKLFSF2 CKLF-like MARVEL transmembrane domain-containing protein 2 (CKLFSF2), CLEC4E C-type lectin domain family 4, member e (CLEC4E), CLU clusterin protein (also known as apoplipoprotein J), CR1 Erythrocyte complement receptor 1 (CR1, also known as CD35, C3b/C4b receptor and immune adherence receptor), CR1L Erythrocyte complement receptor 1 (CR1L), CSF3R granulocyte colony-stimulating factor 3 receptor (CSF3R), CST3 Cystatin C or cystatin 3 CYP2C Cytochrome P450 2C, DAPK1 Death-associated protein kinase 1 (DAPK1), ESR1 Estrogen receptor 1, FCAR Fc fragment of IgA receptor (FCAR, also known as CD89), FCGR3B Fc fragment of IgG, low affinity IIIb, receptor (FCGR3B or CD16b), FFA2 Free fatty acid receptor 2 (FFA2), FGA Fibrinogen (Factor I), GAB2 GRB2-associated-binding protein 2 (GAB2), GAB2 GRB2-associated-binding protein 2 (GAB2), GALP Galanin-like peptide, GAPDHS Glyceraldehyde-3-phosphate dehydrogenase, spermatogenic (GAPDHS), GMPB GMBP HP Haptoglobin (HP), HTR7 5-hydroxytryptamine (serotonin) receptor 7 (adenylate cyclase-coupled), IDE Insulin degrading enzyme IF127 IF127 IFI6 Interferon, alpha-inducible protein 6 (IFI6), IFIT2 Interferon-induced protein with tetratricopeptide repeats 2 (IFIT2), IL1RN interleukin-1 receptor antagonist (IL-1RA), IL8RA Interleukin 8 receptor, alpha (IL8RA or CD181), IL8RB Interleukin 8 receptor, beta (IL8RB), JAG1 Jagged 1 (JAG1), KCNJ15 Potassium inwardly-rectifying channel, subfamily J, member 15 (KCNJ15), LRP6 Low-density lipoprotein receptor-related protein 6 (LRP6), MAPT microtubule-associated protein tau (MAPT), MARK4 MAP/microtubule affinity-regulating kinase 4 (MARK4), MPHOSPH1 M-phase phosphoprotein 1, MTHFR 5,10-methylenetetrahydrofolate reductase, MX2 Interferon-induced GTP-binding protein Mx2, NBN Nibrin, also known as NBN, NCSTN Nicastrin NIACR2 Niacin receptor 2 (NIACR2, also known as GPR109B), NMNAT3 nicotinamide nucleotide adenylyltransferase 3, NTM Neurotrimin (or HNT), ORM1 Orosmucoid 1 (ORM1), or Alpha-1-acid glycoprotein 1, P2RY13 P2Y purinoceptor 13 (P2RY13), PBEF1 Nicotinamide phosphoribosyltransferase (NAmPRTase or Nampt) also known as pre-B-cell colony-enhancing factor 1 (PBEF1), or visfatin PCK1 Phosphoenolpyruvate carboxykinase, PICALM phosphatidylinositol binding clathrin assembly protein (PICALM), PLAU Urokinase-type plasminogen activator (PLAU), PLXNC1 Plexin C1 (PLXNC1), PRNP Prion protein, PSEN1 presenilin 1 protein (PSEN1), PSEN2 presenilin 2 protein (PSEN2), PTPRA protein tyrosine phosphatase receptor type A protein (PTPRA), RALGPS2 Ral GEF with PH domain and SH3 binding motif 2 (RALGPS2), RGSL2 regulator of G-protein signaling like 2 (RGSL2), SELENBP1 Selenium binding protein 1 (SELNBP1), SLC25A37 Mitoferrin-1, SORL1 sortilin-related receptor L(DLR class) A repeats-containing protein (SORL1), TF Transferrin TFAM Mitochondrial transcription factor A TNF Tumor necrosis factor, TNFRSF10C Tumor necrosis factor receptor superfamily member 10C (TNFRSF10C), TNFSF10 Tumor necrosis factor receptor superfamily, (TRAIL) member 10a (TNFSF10), UBA1 ubiquitin-like modifier activating enzyme 1 (UBA1), UBA3 NEDD8-activating enzyme E1 catalytic subunit protein (UBE1C), UBB ubiquitin B protein (UBB), UBQLN1 Ubiquilin-1 UCHL1 ubiquitin carboxyl-terminal esterase L1 protein (UCHL1), UCHL3 ubiquitin carboxyl-terminal hydrolase isozyme L3 protein (UCHL3), VLDLR very low density lipoprotein receptor protein (VLDLR).

In exemplary embodiments, the proteins associated with AD whose chromosomal sequence is edited may be the very low density lipoprotein receptor protein (VLDLR) encoded by the VLDLR gene, the ubiquitin-like modifier activating enzyme 1 (UBA1) encoded by the UBA1 gene, the NEDD8-activating enzyme E1 catalytic subunit protein (UBE1C) encoded by the UBA3 gene, the aquaporin 1 protein (AQP1) encoded by the AQP1 gene, the ubiquitin carboxyl-terminal esterase Li protein (UCHL1) encoded by the UCHL1 gene, the ubiquitin carboxyl-terminal hydrolase isozyme L3 protein (UCHL3) encoded by the UCHL3 gene, the ubiquitin B protein (UBB) encoded by the UBB gene, the microtubule-associated protein tau (MAPT) encoded by the MAPT gene, the protein tyrosine phosphatase receptor type A protein (PTPRA) encoded by the PTPRA gene, the phosphatidylinositol binding clathrin assembly protein (PICALM) encoded by the PICALM gene, the clusterin protein (also known as apoplipoprotein J) encoded by the CLU gene, the presenilin 1 protein encoded by the PSEN1 gene, the presenilin 2 protein encoded by the PSEN2 gene, the sortilin-related receptor L(DLR class) A repeats-containing protein (SORL1) protein encoded by the SORL1 gene, the amyloid precursor protein (APP) encoded by the APP gene, the Apolipoprotein E precursor (APOE) encoded by the APOE gene, or the brain-derived neurotrophic factor (BDNF) encoded by the BDNF gene. In an exemplary embodiment, the genetically modified animal is a rat, and the edited chromosomal sequence encoding the protein associated with AD is as follows: APP amyloid precursor protein (APP), NM 019288 AQP1 aquaporin 1 protein (AQP1), NM 012778 BDNF Brain-derived neurotrophic factor, NM_012513 CLU clusterin protein (also known as NM_053021 apoplipoprotein J), MAPT microtubule-associated protein NM_017212 tau (MAPT), PICALM phosphatidylinositol binding NM_053554 clathrin assembly protein (PICALM), PSEN1 presenilin 1 protein (PSEN1), NM 019163 PSEN2 presenilin 2 protein (PSEN2), NM_031087 PTPRA protein tyrosine phosphatase NM_012763 receptor type A protein (PTPRA), SORL1 sortilin-related receptor L(DLR NM_053519, class) A repeats-containing XM_001065506, protein (SORL1), XM_217115 UBA1 ubiquitin-like modifier activating NM_001014080 enzyme 1 (UBA1), UBA3 NEDD8-activating enzyme E1 NM_057205 catalytic subunit protein (UBE1C), UBB ubiquitin B protein (UBB), NM_138895 UCHL1 ubiquitin carboxyl-terminal NM_017237 esterase L1 protein (UCHL1), UCHL3 ubiquitin carboxyl-terminal NM_001110165 hydrolase isozyme L3 protein (UCHL3), VLDLR very low density lipoprotein NM_013155 receptor protein (VLDLR).

The animal or cell may comprise 1, 2, 3, 4, 5, 6, 7, 8, 9, 10, 11, 12, 13, 14, 15 or more disrupted chromosomal sequences encoding a protein associated with AD and zero, 1, 2, 3, 4, 5, 6, 7, 8, 9, 10, 11, 12, 13, 14, 15 or more chromosomally integrated sequences encoding a protein associated with AD.

The edited or integrated chromosomal sequence may be modified to encode an altered protein associated with AD. A number of mutations in AD-related chromosomal sequences have been associated with AD. For instance, the V7171 (i.e., valine at position 717 is changed to isoleucine) missense mutation in APP causes familial AD. Multiple mutations in the presenilin-1 protein, such as H163R (i.e., histidine at position 163 is changed to arginine), A246E (i.e., alanine at position 246 is changed to glutamate), L286V (i.e., leucine at position 286 is changed to valine) and C410Y (i.e., cysteine at position 410 is changed to tyrosine) cause familial Alzheimer's type 3. Mutations in the presenilin-2 protein, such as N141 I (i.e., asparagine at position 141 is changed to isoleucine), M239V (i.e., methionine at position 239 is changed to valine), and D439A (i.e., aspartate at position 439 is changed to alanine) cause familial Alzheimer's type 4. Other associations of genetic variants in AD-associated genes and disease are known in the art. See, for example, Waring et al. (2008) Arch. Neurol. 65:329-334, the disclosure of which is incorporated by reference herein in its entirety.

Secretase Disorders

US Patent Publication No. 20110023146, describes use of zinc finger nucleases to genetically modify cells, animals and proteins associated with secretase-associated disorders. Secretases are essential for processing pre-proteins into their biologically active forms. A person with ordinary skill in the art may use the method disclosed herein in a system similar to that in US Patent Publication No. 20010023146 with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Defects in various components of the secretase pathways contribute to many disorders, particularly those with hallmark amyloidogenesis or amyloid plaques, such as Alzheimer's disease (AD).

A secretase disorder and the proteins associated with these disorders are a diverse set of proteins that effect susceptibility for numerous disorders, the presence of the disorder, the severity of the disorder, or any combination thereof. The present disclosure comprises editing of any chromosomal sequences that encode proteins associated with a secretase disorder. The proteins associated with a secretase disorder are typically selected based on an experimental association of the secretase-related proteins with the development of a secretase disorder. For example, the production rate or circulating concentration of a protein associated with a secretase disorder may be elevated or depressed in a population with a secretase disorder relative to a population without a secretase disorder. Differences in protein levels may be assessed using proteomic techniques including, but not limited to, Western blot, immunohistochemical staining, enzyme linked immunosorbent assay (ELISA), and mass spectrometry. Alternatively, the protein associated with a secretase disorder may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR).

By way of non-limiting example, proteins associated with a secretase disorder include PSENEN (presenilin enhancer 2 homolog (*C. elegans*)), CTSB (cathepsin B), PSEN1 (presenilin 1), APP (amyloid beta (A4) precursor protein), APH1B (anterior pharynx defective 1 homolog B (*C. elegans*)), PSEN2 (presenilin 2 (Alzheimer disease 4)), BACE1 (beta-site APP-cleaving enzyme 1), ITM2B (integral membrane protein 2B), CTSD (cathepsin D), NOTCH1 (Notch homolog 1, translocation-associated (*Drosophila*)), TNF (tumor necrosis factor (TNF superfamily, member 2)), INS (insulin), DYT10 (dystonia 10), ADAM17 (ADAM metallopeptidase domain 17), APOE (apolipoprotein E), ACE (angiotensin I converting enzyme (peptidyl-dipeptidase A) 1), STN (statin), TP53 (tumor protein p53), IL6 (interleukin 6 (interferon, beta 2)), NGFR (nerve growth factor receptor (TNFR superfamily, member 16)), IL1B (interleukin 1, beta), ACHE (acetylcholinesterase (Yt blood group)), CTNNB1 (catenin (cadherin-associated protein), beta 1, 88 kDa), IGF1 (insulin-like growth factor 1 (somatomedin C)), IFNG (interferon, gamma), NRG1 (neuregulin 1), CASP3 (caspase 3, apoptosis-related cysteine peptidase), MAPK1 (mitogen-activated protein kinase 1), CDH1 (cadherin 1, type 1, E-cadherin (epithelial)), APBB1 (amyloid beta (A4) precursor protein-binding, family B, member 1 (Fe65)), HMGCR (3-hydroxy-3-methylglutaryl-Coenzyme A reductase), CREB1 (cAMP responsive element binding protein 1), PTGS2 (prostaglandin-endoperoxide synthase 2 (prostaglandin G/H synthase and cyclooxygenase)), HES1 (hairy and enhancer of split 1, (*Drosophila*)), CAT (catalase), TGFB1 (transforming growth factor, beta 1), ENO2 (enolase 2 (gamma, neuronal)), ERBB4 (v-erb-a erythroblastic leukemia viral oncogene homolog 4 (avian)), TRAPPC10 (trafficking protein particle complex 10), MAOB (monoamine oxidase B), NGF (nerve growth factor (beta polypeptide)), MMP12 (matrix metallopeptidase 12 (macrophage elastase)), JAG1 (jagged 1 (Alagille syndrome)), CD40LG (CD40 ligand), PPARG (peroxisome proliferator-activated receptor gamma), FGF2 (fibroblast growth factor 2 (basic)), IL3 (interleukin 3 (colony-stimulating factor, multiple)), LRP1 (low density lipoprotein receptor-related protein 1), NOTCH4 (Notch homolog 4 (*Drosophila*)), MAPK8 (mitogen-activated protein kinase 8), PREP (prolyl endopeptidase), NOTCH3 (Notch homolog 3 (*Drosophila*)), PRNP (prion protein), CTSG (cathepsin G), EGF (epidermal growth factor (beta-urogastrone)), REN (renin), CD44 (CD44 molecule (Indian blood group)), SELP (selectin P (granule membrane protein 140 kDa, antigen CD62)), GHR (growth hormone receptor), ADCYAP1 (adenylate cyclase activating polypeptide 1 (pituitary)), INSR (insulin receptor), GFAP (glial fibrillary acidic protein), MMP3 (matrix metallopeptidase 3 (stromelysin 1, progelatinase)), MAPK10 (mitogen-activated protein kinase 10), SP1 (Sp1 transcription factor), MYC (v-myc myelocytomatosis viral oncogene homolog (avian)), CTSE (cathepsin E), PPARA (peroxisome proliferator-activated receptor alpha), JUN (un oncogene), TIMP1 (TIMP metallopeptidase inhibitor 1), IL5 (interleukin 5 (colony-stimulating factor, eosinophil)), IL1A (interleukin 1, alpha), MMP9 (matrix metallopeptidase 9 (gelatinase B, 92 kDa gelatinase, 92 kDa type IV collagenase)), HTR4 (5-hydroxytryptamine (serotonin) receptor 4), HSPG2 (heparan sulfate proteoglycan 2), KRAS (v-Ki-ras2 Kirsten rat sarcoma viral oncogene homolog), CYCS (cytochrome c, somatic), SMG1 (SMG1 homolog, phosphatidylinositol 3-kinase-related kinase (*C. elegans*)), IL1R1 (interleukin 1 receptor, type I), PROK1 (prokineticin 1), MAPK3 (mitogen-activated protein kinase 3), NTRK1 (neurotrophic tyrosine kinase, receptor, type 1), IL13 (interleukin 13), MME (membrane metallo-endopeptidase), TKT (transketolase), CXCR2 (chemokine (C-X-C motif) receptor 2), IGF1R (insulin-like growth factor 1 receptor), RARA (retinoic acid receptor, alpha), CREBBP (CREB binding protein), PTGS1 (prostaglandin-endoperoxide synthase 1 (prostaglandin G/H synthase and cyclooxygenase)), GALT (galactose-1-phosphate uridylyltransferase), CHRM1 (cholinergic receptor, muscarinic 1), ATXN1 (ataxin 1), PAWR (PRKC, apoptosis, WT1, regulator), NOTCH2 (Notch homolog 2 (*Drosophila*)), M6PR (mannose-6-phosphate receptor (cation dependent)), CYP46A1 (cytochrome P450, family 46, subfamily A, polypeptide 1), CSNK1 D (casein kinase 1, delta), MAPK14 (mitogen-activated protein kinase 14), PRG2 (proteoglycan 2, bone marrow (natural killer cell activator, eosinophil granule major basic protein)), PRKCA (protein kinase C, alpha), L1 CAM (L1 cell adhesion molecule), CD40 (CD40 molecule, TNF receptor superfamily member 5), NR1I2 (nuclear receptor subfamily 1, group I, member 2), JAG2 (jagged 2), CTNND1 (catenin (cadherin-associated protein), delta 1), CDH2 (cadherin 2, type 1, N-cadherin (neuronal)), CMA1 (chymase 1, mast cell), SORT1 (sortilin 1), DLK1 (delta-like 1 homolog (*Drosophila*)), THEM4 (thioesterase superfamily member 4), JUP (junction plakoglobin), CD46 (CD46 molecule, complement regulatory protein), CCL11 (chemokine (C-C motif) ligand 11), CAV3 (caveolin 3), RNASE3 (ribonuclease, RNase A family, 3 (eosinophil cationic protein)), HSPA8 (heat shock 70 kDa protein 8), CASP9 (caspase 9, apoptosis-related cysteine peptidase), CYP3A4 (cytochrome P450, family 3, subfamily A, polypeptide 4), CCR3 (chemokine (C-C motif) receptor 3), TFAP2A (transcription factor AP-2 alpha (activating enhancer binding protein 2 alpha)), SCP2 (sterol carrier protein 2), CDK4 (cyclin-dependent kinase 4), HIF1A (hypoxia inducible factor 1, alpha subunit (basic helix-loop-helix transcription factor)), TCF7L2 (transcription factor 7-like 2 (T-cell specific, HMG-box)), IL1R2 (interleukin 1 receptor, type II), B3GALTL (beta 1,3-galactosyltransferase-like), MDM2 (Mdm2 p53 binding protein homolog (mouse)), RELA (v-rel reticuloendotheliosis viral oncogene homolog A (avian)), CASP7 (caspase 7, apoptosis-related cysteine peptidase), IDE (insulin-degrading enzyme), FABP4 (fatty acid binding protein 4, adipocyte), CASK (calcium/calmodulin-dependent serine protein kinase (MAGUK family)), ADCYAP1R1 (adenylate cyclase activating polypeptide 1 (pituitary) receptor type I), ATF4 (activating transcription factor 4 (tax-responsive enhancer element B67)), PDGFA (platelet-derived growth factor alpha polypeptide), C21 or f33 (chromosome 21 open reading frame 33), SCG5 (secretogranin V (7B2 protein)), RNF123 (ring finger protein 123), NFKB1 (nuclear factor of kappa light polypeptide gene enhancer in B-cells 1), ERBB2 (v-erb-b2 erythroblastic leukemia viral oncogene homolog 2, neuro/glioblastoma derived oncogene homolog (avian)), CAV1 (caveolin 1, caveolae protein, 22 kDa), MMP7 (matrix metallopeptidase 7 (matrilysin, uterine)), TGFA (transforming growth factor, alpha), RXRA (retinoid X receptor, alpha), STX1A (syntaxin 1A (brain)), PSMC4 (proteasome (prosome, macropain) 26S subunit, ATPase, 4), P2RY2 (purinergic receptor P2Y, G-protein coupled, 2), TNFRSF21 (tumor necrosis factor receptor superfamily, member 21), DLG1 (discs, large homolog 1 (*Drosophila*)), NUMBL (numb homolog (*Drosophila*)-like), SPN (sialophorin), PLSCR1 (phospholipid scramblase 1), UBQLN2 (ubiquilin 2), UBQLN1 (ubiquilin 1), PCSK7 (proprotein convertase subtilisin/kexin type 7), SPON1 (spondin 1, extracellular matrix protein), SILV (silver homolog (mouse)), QPCT (glutaminyl-peptide cyclotransferase), HESS (hairy and enhancer of split 5 (*Drosophila*)), GCC1 (GRIP and coiled-coil domain containing 1), and any combination thereof.

The genetically modified animal or cell may comprise 1, 2, 3, 4, 5, 6, 7, 8, 9, 10 or more disrupted chromosomal sequences encoding a protein associated with a secretase disorder and zero, 1, 2, 3, 4, 5, 6, 7, 8, 9, 10 or more chromosomally integrated sequences encoding a disrupted protein associated with a secretase disorder.

ALS

US Patent Publication No. 20110023144 describes use of zinc finger nucleases to genetically modify cells, animals and proteins associated with amyotrophyic lateral sclerosis (ALS) disease. ALS is characterized by the gradual steady degeneration of certain nerve cells in the brain cortex, brain stem, and spinal cord involved in voluntary movement. A person with ordinary skill in the art may use the method disclosed herein in a system similar to that in US Patent Publication No. 20110023144 with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In preferred embodiments, the staggered DSB is repaired via HR independent mechanism, such as NHEJ. In some embodiments, the target cell is a non-dividing cell. In a particular embodiment, the target cell is a motor neuron. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Motor neuron disorders and the proteins associated with these disorders are a diverse set of proteins that effect susceptibility for developing a motor neuron disorder, the presence of the motor neuron disorder, the severity of the motor neuron disorder or any combination thereof. The present disclosure comprises editing of any chromosomal sequences that encode proteins associated with ALS disease, a specific motor neuron disorder. The proteins associated with ALS are typically selected based on an experimental association of ALS-related proteins to ALS. For example, the production rate or circulating concentration of a protein associated with ALS may be elevated or depressed in a population with ALS relative to a population without ALS. Differences in protein levels may be assessed using proteomic techniques including, but not limited to, Western blot, immunohistochemical staining, enzyme linked immunosorbent assay (ELISA), and mass spectrometry. Alternatively, the proteins associated with ALS may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR).

By way of non-limiting example, proteins associated with ALS include, but are not limited to, the following proteins: SOD1 superoxide dismutase 1, ALS3 amyotrophic lateral soluble sclerosis 3 SETX senataxin, ALS5 amyotrophic lateral sclerosis 5 FUS fused in sarcoma, ALS7 amyotrophic lateral sclerosis 7, ALS2 amyotrophic lateral DPP6 Dipeptidyl-peptidase 6 sclerosis 2 NEFH neurofilament, heavy PTGS1 prostaglandin-polypeptide endoperoxide synthase 1 SLC1A2 solute carrier family 1, TNFRSF10B tumor necrosis factor (glial high affinity receptor superfamily, glutamate transporter), member 10b member 2 PRPH peripherin HSP90AA1 heat shock protein 90 kDa alpha (cytosolic), class A member 1 GRIA2 glutamate receptor, IFNG interferon, gamma ionotropic, AMPA 2 S100B S100 calcium binding FGF2 fibroblast growth factor 2 protein B AOX1 aldehyde oxidase 1 CS citrate synthase TARDBP TAR DNA binding protein TXN thioredoxin RAPH1 Ras association MAP3K5 mitogen-activated protein (RalGDS/AF-6) and kinase 5 pleckstrin homology domains 1 NBEAL1 neurobeachin-like 1 GPX1 glutathione peroxidase 1 ICA1L islet cell autoantigen RAC1 ras-related C3 botulinum 1.69 kDa-like toxin substrate 1 MAPT microtubule-associated ITPR2 inositol 1,4,5-protein tau triphosphate receptor, type 2 ALS2CR4 amyotrophic lateral GLS glutaminase sclerosis 2 (juvenile) chromosome region, candidate 4 ALS2CR8 amyotrophic lateral CNTFR ciliary neurotrophic factor sclerosis 2 (juvenile) receptor chromosome region, candidate 8 ALS2CR11 amyotrophic lateral FOLH1 folate hydrolase 1 sclerosis 2 (juvenile) chromosome region, candidate 11 FAM117B family with sequence P4HB prolyl 4-hydroxylase, similarity 117, member B beta polypeptide CNTF ciliary neurotrophic factor SQSTM1 sequestosome 1 STRADB STE20-related kinase NAIP NLR family, apoptosis adaptor beta inhibitory protein YWHAQ tyrosine 3-SLC33A1 solute carrier family 33 monooxygenase/tryptoph (acetyl-CoA transporter), an 5-monooxygenase member 1 activation protein, theta polypeptide TRAK2 trafficking protein, homolog, SAC1 kinesin binding 2 lipid phosphatase domain containing NIF3L1 NIF3 NGG1 interacting INA internexin neuronal factor 3-like 1 intermediate filament protein, alpha PARD3B par-3 partitioning COX8A cytochrome c oxidase defective 3 homolog B subunit VIIIA CDK15 cyclin-dependent kinase HECW1 HECT, C2 and WW 15 domain containing E3 ubiquitin protein ligase 1 NOS1 nitric oxide synthase 1 MET met proto-oncogene SOD2 superoxide dismutase 2, HSPB1 heat shock 27 kDa mitochondrial protein 1 NEFL neurofilament, light CTSB cathepsin B polypeptide ANG angiogenin, HSPA8 heat shock 70 kDa ribonuclease, RNase A protein 8 family, 5 VAPB VAMP (vesicle-ESR1 estrogen receptor 1 associated membrane protein)-associated protein B and C SNCA synuclein, alpha HGF hepatocyte growth factor CAT catalase ACTB actin, beta NEFM neurofilament, medium TH tyrosine hydroxylase polypeptide BCL2 B-cell CLL/lymphoma 2 FAS Fas (TNF receptor superfamily, member 6) CASP3 caspase 3, apoptosis-CLU clusterin related cysteine peptidase SMN1 survival of motor neuron G6PD glucose-6-phosphate 1, telomeric dehydrogenase BAX BCL2-associated X HSF1 heat shock transcription protein factor 1 RNF19A ring finger protein 19A JUN jun oncogene ALS2CR12 amyotrophic lateral HSPA5 heat shock 70 kDa sclerosis 2 (juvenile) protein 5 chromosome region, candidate 12 MAPK14 mitogen-activated protein IL10 interleukin 10 kinase 14 APEX1 APEX nuclease TXNRD1 thioredoxin reductase 1 (multifunctional DNA repair enzyme) 1 NOS2 nitric oxide synthase 2, TIMP1 TIMP metallopeptidase inducible inhibitor 1 CASP9 caspase 9, apoptosis-XIAP X-linked inhibitor of related cysteine apoptosis peptidase GLG1 golgi glycoprotein 1 EPO erythropoietin VEGFA vascular endothelial ELN elastin growth factor A GDNF glial cell derived NFE2L2 nuclear factor (erythroid-neurotrophic factor derived 2)-like 2 SLC6A3 solute carrier family 6 HSPA4 heat shock 70 kDa (neurotransmitter protein 4 transporter, dopamine), member 3 APOE apolipoprotein E PSMB8 proteasome (prosome, macropain) subunit, beta type, 8 DCTN1 dynactin 1 TIMP3 TIMP metallopeptidase inhibitor 3 KIFAP3 kinesin-associated SLC1A1 solute carrier family 1 protein 3 (neuronal/epithelial high affinity glutamate transporter, system Xag), member 1 SMN2 survival of motor neuron CCNC cyclin C 2, centromeric MPP4 membrane protein, STUB1 STIPi1 homology and U-palmitoylated 4 box containing protein 1 ALS2 amyloid beta (A4) PRDX6 peroxiredoxin 6 precursor protein SYP synaptophysin CABIN1 calcineurin binding protein 1 CASP1 caspase 1, apoptosis-GART phosphoribosylglycinami related cysteine de formyltransferase, peptidase phosphoribosylglycinami de synthetase, phosphoribosylaminoimi dazole synthetase CDK5 cyclin-dependent kinase 5 ATXN3 ataxin 3 RTN4 reticulon 4 C1QB complement component 1, q subcomponent, B chain VEGFC nerve growth factor HTT huntingtin receptor PARK7 Parkinson disease 7 XDH xanthine dehydrogenase GFAP glial fibrillary acidic MAP2 microtubule-associated protein protein 2 CYCS cytochrome c, somatic FCGR3B Fc fragment of IgG, low affinity IIIb, CCS copper chaperone for UBL5 ubiquitin-like 5 superoxide dismutase MMP9 matrix metallopeptidase SLC18A3 solute carrier family 18 9 (vesicular acetylcholine), member 3 TRPM7 transient receptor HSPB2 heat shock 27 kDa potential cation channel, protein 2 subfamily M, member 7 AKT1 v-akt murine thymoma DERL1 Derl-like domain family, viral oncogene homolog 1 member 1 CCL2 chemokine (C-C motif) NGRN neugrin, neurite ligand 2 outgrowth associated GSR glutathione reductase TPPP3 tubulin polymerization-promoting protein family member 3 APAF1 apoptotic peptidase BTBD10 BTB (POZ) domain activating factor 1 containing 10 GLUD1 glutamate CXCR4 chemokine (C-X-C motif) dehydrogenase 1 receptor 4 SLC1A3 solute carrier family 1 FLT1 fms-related tyrosine (glial high affinity glutamate transporter), member 3 kinase 1 PON1 paraoxonase 1 AR androgen receptor LIF leukemia inhibitory factor ERBB3 v-erb-b2 erythroblastic leukemia viral oncogene homolog 3 LGALS1 lectin, galactoside-CD44 CD44 molecule binding, soluble, 1 TP53 tumor protein p53 TLR3 toll-like receptor 3 GRIAl glutamate receptor, GAPDH glyceraldehyde-3-ionotropic, AMPA 1 phosphate dehydrogenase GRIK1 glutamate receptor, DES desmin ionotropic, kainate 1 CHAT choline acetyltransferase FLT4 fms-related tyrosine kinase 4 CHMP2B chromatin modifying BAG1 BCL2-associated protein 2B athanogene MT3 metallothionein 3 CHRNA4 cholinergic receptor, nicotinic, alpha 4 GSS glutathione synthetase BAK1 BCL2-antagonist/killer 1 KDR kinase insert domain GSTP1 glutathione S-transferase receptor (a type III pi 1 receptor tyrosine kinase) OGG1 8-oxoguanine DNA IL6 interleukin 6 (interferon, glycosylase beta 2).

The animal or cell may comprise 1, 2, 3, 4, 5, 6, 7, 8, 9, 10 or more disrupted chromosomal sequences encoding a protein associated with ALS and zero, 1, 2, 3, 4, 5, 6, 7, 8, 9, 10 or more chromosomally integrated sequences encoding the disrupted protein associated with ALS. Preferred proteins associated with ALS include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vascular endothelial growth factor C), and any combination thereof.

Autism

US Patent Publication No. 20110023145 describes use of zinc finger nucleases to genetically modify cells, animals and proteins associated with autism spectrum disorders (ASD). Autism spectrum disorders (ASDs) are a group of disorders characterized by qualitative impairment in social interaction and communication, and restricted repetitive and stereotyped patterns of behavior, interests, and activities. The three disorders, autism, Asperger syndrome (AS) and pervasive developmental disorder-not otherwise specified (PDD-NOS) are a continuum of the same disorder with varying degrees of severity, associated intellectual functioning and medical conditions. ASDs are predominantly genetically determined disorders with a heritability of around 90%.

US Patent Publication No. 20110023145 comprises editing of any chromosomal sequences that encode proteins associated with ASD which may be applied to the CRISPR Cas system of the present invention. The proteins associated with ASD are typically selected based on an experimental association of the protein associated with ASD to an incidence or indication of an ASD. For example, the production rate or circulating concentration of a protein associated with ASD may be elevated or depressed in a population having an ASD relative to a population lacking the ASD. Differences in protein levels may be assessed using proteomic techniques including, but not limited to, Western blot, immunohistochemical staining, enzyme linked immunosorbent assay (ELISA), and mass spectrometry. Alternatively, the proteins associated with ASD may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR). A person with ordinary skill in the art may use the method disclosed herein in a system similar to that in US Patent Publication No. 20110023145 with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Non limiting examples of disease states or disorders that may be associated with proteins associated with ASD include autism, Asperger syndrome (AS), pervasive developmental disorder-not otherwise specified (PDD-NOS), Rett's syndrome, tuberous sclerosis, phenylketonuria, Smith-Lemli-Opitz syndrome and fragile X syndrome. By way of non-limiting example, proteins associated with ASD include, but are not limited to, the following proteins: ATP10C aminophospholipid-MET MET receptor transporting ATPase tyrosine kinase (ATP10C) BZRAP1 MGLUR5 (GRM5) Metabotropic glutamate receptor 5 (MGLUR5) CDH10 Cadherin-10 MGLUR6 (GRM6) Metabotropic glutamate receptor 6 (MGLUR6) CDH9 Cadherin-9 NLGN1 Neuroligin-1 CNTN4 Contactin-4 NLGN2 Neuroligin-2 CNTNAP2 Contactin-associated SEMA5A Neuroligin-3 protein-like 2 (CNTNAP2) DHCR7 7-dehydrocholesterol NLGN4X Neuroligin-4 X-reductase (DHCR7) linked DOC2A Double C2-like domain-NLGN4Y Neuroligin-4 Y-containing protein alpha linked DPP6 Dipeptidyl NLGN5 Neuroligin-5 aminopeptidase-like protein 6 EN2 engrailed 2 (EN2) NRCAM Neuronal cell adhesion molecule (NRCAM) MDGA2 fragile X mental retardation NRXN1 Neurexin-1 1 (MDGA2) FMR2 (AFF2) AF4/FMR2 family member 2 OR4M2 Olfactory receptor (AFF2) 4M2 FOXP2 Forkhead box protein P2 OR4N4 Olfactory receptor (FOXP2) 4N4 FXR1 Fragile X mental OXTR oxytocin receptor retardation, autosomal (OXTR) homolog 1 (FXR1) FXR2 Fragile X mental PAH phenylalanine retardation, autosomal hydroxylase (PAH) homolog 2 (FXR2) GABRA1 Gamma-aminobutyric acid PTEN Phosphatase and receptor subunit alpha-1 tensin homologue (GABRA1) (PTEN) GABRA5 GABAA (.gamma.-aminobutyric PTPRZ1 Receptor-type acid) receptor alpha 5 tyrosine-protein subunit (GABRA5) phosphatase zeta (PTPRZ1) GABRB1 Gamma-aminobutyric acid RELN Reelin receptor subunit beta-1 (GABRBI) GABRB3 GABAA (.gamma.-aminobutyric RPL10 60S ribosomal acid) receptor .beta.3 subunit protein L10 (GABRB3) GABRG1 Gamma-aminobutyric acid SEMA5A Semaphorin-5A receptor subunit gamma-1 (SEMA5A) (GABRG1) HIRIP3 HIRA-interacting protein 3 SEZ6L2 seizure related 6 homolog (mouse)-like 2 HOXA1 Homeobox protein Hox-A1 SHANK3 SH3 and multiple (HOXA1) ankyrin repeat domains 3 (SHANK3) IL6 Interleukin-6 SHBZRAP1 SH3 and multiple ankyrin repeat domains 3 (SHBZRAP1) LAMB1 Laminin subunit beta-1 SLC6A4 Serotonin (LAMB1) transporter (SERT) MAPK3 Mitogen-activated protein TAS2R1 Taste receptor kinase 3 type 2 member 1 TAS2R1 MAZ Myc-associated zinc finger TSC1 Tuberous sclerosis protein protein 1 MDGA2 MAM domain containing TSC2 Tuberous sclerosis glycosylphosphatidylinositol protein 2 anchor 2 (MDGA2) MECP2 Methyl CpG binding UBE3A Ubiquitin protein protein 2 (MECP2) ligase E3A (UBE3A) MECP2 methyl CpG binding WNT2 Wingless-type protein 2 (MECP2) MMTV integration site family, member 2 (WNT2).

The identity of the protein associated with ASD whose chromosomal sequence is edited can and will vary. In preferred embodiments, the proteins associated with ASD whose chromosomal sequence is edited may be the benzodiazapine receptor (peripheral) associated protein 1 (BZRAP1) encoded by the BZRAP1 gene, the AF4/FMR2 family member 2 protein (AFF2) encoded by the AFF2 gene (also termed MFR2), the fragile X mental retardation autosomal homolog 1 protein (FXR1) encoded by the FXR1 gene, the fragile X mental retardation autosomal homolog 2 protein (FXR2) encoded by the FXR2 gene, the MAM domain containing glycosylphosphatidylinositol anchor 2 protein (MDGA2) encoded by the MDGA2 gene, the methyl CpG binding protein 2 (MECP2) encoded by the MECP2 gene, the metabotropic glutamate receptor 5 (MGLUR5) encoded by the MGLUR5-1 gene (also termed GRM5), the neurexin 1 protein encoded by the NRXN1 gene, or the semaphorin-5A protein (SEMA5A) encoded by the SEMA5A gene. In an exemplary embodiment, the genetically modified animal is a rat, and the edited chromosomal sequence encoding the protein associated with ASD is as listed below: BZRAP1 benzodiazapine receptor XM_002727789, (peripheral) associated XM_213427, protein 1 (BZRAP1) XM_002724533, XM_001081125 AFF2 (FMR2) AF4/FMR2 family member 2 XM_219832, (AFF2) XM_001054673 FXR1 Fragile X mental NM_001012179 retardation, autosomal homolog 1 (FXR1) FXR2 Fragile X mental NM_001100647 retardation, autosomal homolog 2 (FXR2) MDGA2 MAM domain containing NM_199269 glycosylphosphatidylinositol anchor 2 (MDGA2) MECP2 Methyl CpG binding NM_022673 protein 2 (MECP2) MGLUR5 Metabotropic glutamate NM_017012 (GRM5) receptor 5 (MGLUR5) NRXN1 Neurexin-1 NM_021767 SEMA5A Semaphorin-5A (SEMA5A) NM_001107659.

Trinucleotide Repeat Expansion Disorders

US Patent Publication No. 20110016540 describes use of zinc finger nucleases to genetically modify cells, animals and proteins associated with trinucleotide repeat expansion disorders. Trinucleotide repeat expansion disorders are complex, progressive disorders that involve developmental neurobiology and often affect cognition as well as sensori-motor functions. A person with ordinary skill in the art may use the method disclosed herein in a system similar to that in US Patent Publication No. 20110016540 with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Trinucleotide repeat expansion proteins are a diverse set of proteins associated with susceptibility for developing a trinucleotide repeat expansion disorder, the presence of a trinucleotide repeat expansion disorder, the severity of a trinucleotide repeat expansion disorder or any combination thereof. Trinucleotide repeat expansion disorders are divided into two categories determined by the type of repeat. The most common repeat is the triplet CAG, which, when present in the coding region of a gene, codes for the amino acid glutamine (Q). Therefore, these disorders are referred to as the polyglutamine (polyQ) disorders and comprise the following diseases: Huntington Disease (HD); Spinobulbar Muscular Atrophy (SBMA); Spinocerebellar Ataxias (SCA types 1, 2, 3, 6, 7, and 17); and Dentatorubro-Pallidoluysian Atrophy (DRPLA). The remaining trinucleotide repeat expansion disorders either do not involve the CAG triplet or the CAG triplet is not in the coding region of the gene and are, therefore, referred to as the non-polyglutamine disorders. The non-polyglutamine disorders comprise Fragile X Syndrome (FRAXA); Fragile XE Mental Retardation (FRAXE); Friedreich Ataxia (FRDA); Myotonic Dystrophy (DM); and Spinocerebellar Ataxias (SCA types 8, and 12).

The proteins associated with trinucleotide repeat expansion disorders are typically selected based on an experimental association of the protein associated with a trinucleotide repeat expansion disorder to a trinucleotide repeat expansion disorder. For example, the production rate or circulating concentration of a protein associated with a trinucleotide repeat expansion disorder may be elevated or depressed in a population having a trinucleotide repeat expansion disorder relative to a population lacking the trinucleotide repeat expansion disorder. Differences in protein levels may be assessed using proteomic techniques including, but not limited to, Western blot, immunohistochemical staining, enzyme linked immunosorbent assay (ELISA), and mass spectrometry. Alternatively, the proteins associated with trinucleotide repeat expansion disorders may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR).

Non-limiting examples of proteins associated with trinucleotide repeat expansion disorders include AR (androgen receptor), FMR1 (fragile X mental retardation 1), HTT (huntingtin), DMPK (dystrophia myotonica-protein kinase), FXN (frataxin), ATXN2 (ataxin 2), ATN1 (atrophin 1), FEN1 (flap structure-specific endonuclease 1), TNRC6A (trinucleotide repeat containing 6A), PABPN1 (poly(A) binding protein, nuclear 1), JPH3 (junctophilin 3), MED15 (mediator complex subunit 15), ATXN1 (ataxin 1), ATXN3 (ataxin 3), TBP (TATA box binding protein), CACNA1A (calcium channel, voltage-dependent, P/Q type, alpha 1A subunit), ATXN80S (ATXN8 opposite strand (non-protein coding)), PPP2R2B (protein phosphatase 2, regulatory subunit B, beta), ATXN7 (ataxin 7), TNRC6B (trinucleotide repeat containing 6B), TNRC6C (trinucleotide repeat containing 6C), CELF3 (CUGBP, Elav-like family member 3), MAB21L1 (mab-21-like 1 (*C. elegans*)), MSH2 (mutS homolog 2, colon cancer, nonpolyposis type 1 (*E. coli*)), TMEM185A (transmembrane protein 185A), SIX5 (SIX homeobox 5), CNPY3 (canopy 3 homolog (zebrafish)), FRAXE (fragile site, folic acid type, rare, fra(X)(q28) E), GNB2 (guanine nucleotide binding protein (G protein), beta polypeptide 2), RPL14 (ribosomal protein L14), ATXN8 (ataxin 8), INSR (insulin receptor), TTR (transthyretin), EP400 (E1A binding protein p400), GIGYF2 (GRB10 interacting GYF protein 2), OGG1 (8-oxoguanine DNA glycosylase), STC1 (stanniocalcin 1), CNDP1 (carnosine dipeptidase 1 (metallopeptidase M20 family)), C10orf2 (chromosome 10 open reading frame 2), MAML3 mastermind-like 3 (*Drosophila*), DKC1 (dyskeratosis congenita 1, dyskerin), PAXIP1 (PAX interacting (with transcription-activation domain) protein 1), CASK (calcium/calmodulin-dependent serine protein kinase (MAGUK family)), MAPT (microtubule-associated protein tau), SP1 (Sp1 transcription factor), POLG (polymerase (DNA directed), gamma), AFF2 (AF4/FMR2 family, member 2), THBS1 (thrombospondin 1), TP53 (tumor protein p53), ESR1 (estrogen receptor 1), CGGBP1 (CGG triplet repeat binding protein 1), ABT1 (activator of basal transcription 1), KLK3 (kallikrein-related peptidase 3), PRNP (prion protein), JUN (jun oncogene), KCNN3 (potassium intermediate/small conductance calcium-activated channel, subfamily N, member 3), BAX (BCL2-associated X protein), FRAXA (fragile site, folic acid type, rare, fra(X)(q27.3) A (macroorchidism, mental retardation)), KBTBD10 (kelch repeat and BTB (POZ) domain containing 10), MBNL1 (muscleblind-like (*Drosophila*)), RAD51 (RAD51 homolog (RecA homolog, *E. coli*) (*S. cerevisiae*)), NCOA3 (nuclear receptor coactivator 3), ERDAl (expanded repeat domain, CAG/CTG 1), TSC1 (tuberous sclerosis 1), COMP (cartilage oligomeric matrix protein), GCLC (glutamate-cysteine ligase, catalytic subunit), RRAD (Ras-related associated with diabetes), MSH3 (mutS homolog 3 (*E. coli*)), DRD2 (dopamine receptor D2), CD44 (CD44 molecule (Indian blood group)), CTCF (CCCTC-binding factor (zinc finger protein)), CCND1 (cyclin D1), CLSPN (claspin homolog (*Xenopus laevis*)), MEF2A (myocyte enhancer factor 2A), PTPRU (protein tyrosine phosphatase, receptor type, U), GAPDH (glyceraldehyde-3-phosphate dehydrogenase), TRIM22 (tripartite motif-containing 22), WT1 (Wilms tumor 1), AHR (aryl hydrocarbon receptor), GPX1 (glutathione peroxidase 1), TPMT (thiopurine S-methyltransferase), NDP (Norrie disease (pseudoglioma)), ARX (aristaless related homeobox), MUS81 (MUS81 endonuclease homolog (*S. cerevisiae*)), TYR (tyrosinase (oculocutaneous albinism IA)), EGR1 (early growth response 1), UNG (uracil-DNA glycosylase), NUMBL (numb homolog (*Drosophila*)-like), FABP2 (fatty acid binding protein 2, intestinal), EN2 (engrailed homeobox 2), CRYGC (crystallin, gamma C), SRP14 (signal recognition particle 14 kDa (homologous Alu RNA binding protein)), CRYGB (crystallin, gamma B), PDCD1 (programmed cell death 1), HOXA1 (homeobox A1), ATXN2L (ataxin 2-like), PMS2 (PMS2 postmeiotic segregation increased 2 (*S. cerevisiae*)), GLA (galactosidase, alpha), CBL (Cas-Br-M (murine) ecotropic retroviral transforming sequence), FTH1 (ferritin, heavy polypeptide 1), IL12RB2 (interleukin 12 receptor, beta 2), OTX2 (orthodenticle homeobox 2), HOXA5 (homeobox A5), POLG2 (polymerase (DNA directed), gamma 2, accessory subunit), DLX2 (distal-less homeobox 2), SIRPA (signal-regulatory protein alpha), OTX1 (orthodenticle homeobox 1), AHRR (aryl-hydrocarbon receptor repressor), MANF (mesencephalic astrocyte-derived neurotrophic factor), TMEM158 (transmembrane protein 158 (gene/pseudogene)), and ENSG00000078687.

Preferred proteins associated with trinucleotide repeat expansion disorders include HTT (Huntingtin), AR (androgen receptor), FXN (frataxin), Atxn3 (ataxin), Atxnl (ataxin), Atxn2 (ataxin), Atxn7 (ataxin), Atxnl0 (ataxin), DMPK (dystrophia myotonica-protein kinase), Atn1 (atrophin 1), CBP (creb binding protein), VLDLR (very low density lipoprotein receptor), and any combination thereof.

Treating Hearing Diseases

The present invention also contemplates delivering the CRISPR-Cas system to one or both ears.

Researchers are looking into whether gene therapy could be used to aid current deafness treatments—namely, cochlear implants. Deafness is often caused by lost or damaged hair cells that cannot relay signals to auditory neurons. In such cases, cochlear implants may be used to respond to sound and transmit electrical signals to the nerve cells. But these neurons often degenerate and retract from the cochlea as fewer growth factors are released by impaired hair cells.

US patent application 20120328580 describes injection of a pharmaceutical composition into the ear (e.g., auricular administration), such as into the luminae of the cochlea (e.g., the Scala media, Sc vestibulae, and Sc tympani), e.g., using a syringe, e.g., a single-dose syringe. For example, one or more of the compounds described herein can be administered by intratympanic injection (e.g., into the middle ear), and/or injections into the outer, middle, and/or inner ear. Such methods are routinely used in the art, for example, for the administration of steroids and antibiotics into human ears. Injection can be, for example, through the round window of the ear or through the cochlear capsule. Other inner ear administration methods are known in the art (see, e.g., Salt and Plontke, Drug Discovery Today, 10:1299-1306, 2005).

In another mode of administration, the pharmaceutical composition can be administered in situ, via a catheter or pump. A catheter or pump can, for example, direct a pharmaceutical composition into the cochlear luminae or the round window of the ear and/or the lumen of the colon. Exemplary drug delivery apparatus and methods suitable for administering one or more of the compounds described herein into an ear, e.g., a human ear, are described by McKenna et al., (U.S. Publication No. 2006/0030837) and Jacobsen et al., (U.S. Pat. No. 7,206,639). In some embodiments, a catheter or pump can be positioned, e.g., in the ear (e.g., the outer, middle, and/or inner ear) of a patient during a surgical procedure. In some embodiments, a catheter or pump can be positioned, e.g., in the ear (e.g., the outer, middle, and/or inner ear) of a patient without the need for a surgical procedure.

Alternatively or in addition, one or more of the compounds described herein can be administered in combination with a mechanical device such as a cochlear implant or a hearing aid, which is worn in the outer ear. An exemplary cochlear implant that is suitable for use with the present invention is described by Edge et al., (U.S. Publication No. 2007/0093878).

In some embodiments, the modes of administration described above may be combined in any order and can be simultaneous or interspersed.

Alternatively or in addition, the present invention may be administered according to any of the Food and Drug Administration approved methods, for example, as described in CDER Data Standards Manual, version number 004 (which is available at fda.give/cder/dsm/DRG/drg00301.htm).

In general, the cell therapy methods described in US patent application 20120328580 can be used to promote complete or partial differentiation of a cell to or towards a mature cell type of the inner ear (e.g., a hair cell) in vitro. Cells resulting from such methods can then be transplanted or implanted into a patient in need of such treatment. The cell culture methods required to practice these methods, including methods for identifying and selecting suitable cell types, methods for promoting complete or partial differentiation of selected cells, methods for identifying complete or partially differentiated cell types, and methods for implanting complete or partially differentiated cells are described below.

Cells suitable for use in the present invention include, but are not limited to, cells that are capable of differentiating completely or partially into a mature cell of the inner ear, e.g., a hair cell (e.g., an inner and/or outer hair cell), when contacted, e.g., in vitro, with one or more of the compounds described herein. Exemplary cells that are capable of differentiating into a hair cell include, but are not limited to stem cells (e.g., inner ear stem cells, adult stem cells, bone marrow derived stem cells, embryonic stem cells, mesenchymal stem cells, skin stem cells, iPS cells, and fat derived stem cells), progenitor cells (e.g., inner ear progenitor cells), support cells (e.g., Deiters' cells, pillar cells, inner phalangeal cells, tectal cells and Hensen's cells), and/or germ cells. The use of stem cells for the replacement of inner ear sensory cells is described in Li et al., (U.S. Publication No. 2005/0287127) and Li et al., (U.S. patent Ser. No. 11/953, 797). The use of bone marrow derived stem cells for the replacement of inner ear sensory cells is described in Edge et al., PCT/US2007/084654. iPS cells are described, e.g., at Takahashi et al., Cell, Volume 131, Issue 5, Pages 861-872 (2007); Takahashi and Yamanaka, Cell 126, 663-76 (2006); Okita et al., Nature 448, 260-262 (2007); Yu, J. et al., Science 318(5858):1917-1920 (2007); Nakagawa et al., Nat. Biotechnol. 26:101-106 (2008); and Zaehres and Scholer, Cell 131(5):834-835 (2007). Such suitable cells can be identified by analyzing (e.g., qualitatively or quantitatively) the presence of one or more tissue specific genes. For example, gene expression can be detected by detecting the protein product of one or more tissue-specific genes. Protein detection techniques involve staining proteins (e.g., using cell extracts or whole cells) using antibodies against the appropriate antigen. In this case, the appropriate antigen is the protein product of the tissue-specific gene expression. Although, in principle, a first antibody (i.e., the antibody that binds the antigen) can be labeled, it is more common (and improves the visualization) to use a second antibody directed against the first (e.g., an anti-IgG). This second antibody is conjugated either with fluorochromes, or appropriate enzymes for colorimetric reactions, or gold beads (for electron microscopy), or with the biotin-avidin system, so that the location of the primary antibody, and thus the antigen, can be recognized.

The CRISPR Cas molecules of the present invention may be delivered to the ear by direct application of pharmaceutical composition to the outer ear, with compositions modified from US Published application, 20110142917. In some embodiments, the pharmaceutical composition is applied to the ear canal. Delivery to the ear may also be referred to as aural or optic delivery.

A person with ordinary skill in the art may use the method disclosed herein in a system similar as in above discussed patent publications with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Qi et al. discloses methods for efficient siRNA transfection to the inner ear through the intact round window by a novel proteidic delivery technology which may be applied to the nucleic acid-targeting system of the present invention (see, e.g., Qi et al., Gene Therapy (2013), 1-9). In particular, a TAT double stranded RNA-binding domains (TAT-DRBDs), which can transfect Cy3-labeled siRNA into cells of the inner ear, including the inner and outer hair cells, *Crista ampullaris*, macula utriculi and macula sacculi, through intact round-window permeation was successful for delivering double stranded siRNAs in vivo for treating various inner ear ailments and preservation of hearing function. About 40 μl of 10 mM RNA may be contemplated as the dosage for administration to the ear.

According to Rejali et al. (Hear Res. 2007 June; 228(1-2):180-7), cochlear implant function can be improved by good preservation of the spiral ganglion neurons, which are the target of electrical stimulation by the implant and brain derived neurotrophic factor (BDNF) has previously been shown to enhance spiral ganglion survival in experimentally deafened ears. Rejali et al. tested a modified design of the cochlear implant electrode that includes a coating of fibroblast cells transduced by a viral vector with a BDNF gene insert. To accomplish this type of ex vivo gene transfer, Rejali et al. transduced guinea pig fibroblasts with an adenovirus with a BDNF gene cassette insert, and determined that these cells secreted BDNF and then attached BDNF-secreting cells to the cochlear implant electrode via an agarose gel, and implanted the electrode in the scala tympani. Rejali et al. determined that the BDNF expressing electrodes were able to preserve significantly more spiral ganglion neurons in the basal turns of the cochlea after 48 days of implantation when compared to control electrodes and demonstrated the feasibility of combining cochlear implant therapy with ex vivo gene transfer for enhancing spiral ganglion neuron survival. Such a system may be applied to the nucleic acid-targeting system of the present invention for delivery to the ear.

Mukherjea et al. (Antioxidants & Redox Signaling, Volume 13, Number 5, 2010) document that knockdown of NOX3 using short interfering (si) RNA abrogated cisplatin ototoxicity, as evidenced by protection of OHCs from damage and reduced threshold shifts in auditory brainstem responses (ABRs). Different doses of siNOX3 (0.3, 0.6, and 0.9 μg) were administered to rats and NOX3 expression was evaluated by real time RT-PCR. The lowest dose of NOX3 siRNA used (0.3 μg) did not show any inhibition of NOX3 mRNA when compared to transtympanic administration of scrambled siRNA or untreated *cochleae*. However, administration of the higher doses of NOX3 siRNA (0.6 and 0.9 μg) reduced NOX3 expression compared to control scrambled siRNA. Such a system may be applied to the CRISPR Cas system of the present invention for transtympanic administration with a dosage of about 2 mg to about 4 mg of CRISPR Cas for administration to a human.

Jung et al. (Molecular Therapy, vol. 21 no. 4, 834-841 April 2013) demonstrate that Hes5 levels in the utricle decreased after the application of siRNA and that the number of hair cells in these utricles was significantly larger than following control treatment. The data suggest that siRNA technology may be useful for inducing repair and regeneration in the inner ear and that the Notch signaling pathway is a potentially useful target for specific gene expression inhibition. Jung et al. injected 8 μg of Hes5 siRNA in 2 μl volume, prepared by adding sterile normal saline to the lyophilized siRNA to a vestibular epithelium of the ear. Such a system may be applied to the nucleic acid-targeting system of the present invention for administration to the vestibular epithelium of the ear with a dosage of about 1 to about 30 mg of CRISPR Cas for administration to a human. A person with ordinary skill in the art may use the method disclosed herein in a system similar to the above described patent publications with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Gene Targeting in Non-Dividing Cells (Neurons & Muscle)

Non-dividing (especially non-dividing, fully differentiated) cell types present issues for gene targeting or genome engineering, for example because homologous recombination (HR) is generally suppressed in the G1 cell-cycle phase. However, while studying the mechanisms by which cells control normal DNA repair systems, Durocher discovered a previously unknown switch that keeps HR "off" in non-dividing cells and devised a strategy to toggle this switch back on. Orthwein et al. (Daniel Durocher's lab at the Mount Sinai Hospital in Ottawa, Canada) recently reported (Nature 16142, published online 9 Dec. 2015) have shown that the suppression of HR can be lifted and gene targeting successfully concluded in both kidney (293T) and osteosarcoma (U20S) cells. Tumor suppressors, BRCA1, PALB2 and BRAC2 are known to promote DNA DSB repair by HR. They found that formation of a complex of BRCA1 with PALB2-BRAC2 is governed by a ubiquitin site on PALB2, such that action on the site by an E3 ubiquitin ligase. This E3 ubiquitin ligase is composed of KEAP1 (a PALB2-interacting protein) in complex with cullin-3 (CUL3)-RBX1. PALB2 ubiquitylation suppresses its interaction with BRCA1 and is counteracted by the deubiquitylase USP11, which is itself under cell cycle control. Restoration of the BRCA1-PALB2 interaction combined with the activation of DNA-end resection is sufficient to induce homologous recombination in G1, as measured by a number of methods including a CRISPR-Cas9-based gene-targeting assay directed at USP 11 or KEAP1 (expressed from a pX459 vector). However, when the BRCA1-PALB2 interaction was restored in resection-competent G1 cells using either KEAP1 depletion or expression of the PALB2-KR mutant, a robust increase in gene-targeting events was detected.

Thus, reactivation of HR in cells, especially non-dividing, fully differentiated cell types is preferred, in some embodiments. In some embodiments, promotion of the BRCA1-PALB2 interaction is preferred. In some embodiments, the target cell is a non-dividing cell. In some embodiments, the target cell is a neuron or muscle cell. In some embodiments, the target cell is targeted in vivo. In some embodiments, the cell is in G1 and HR is suppressed. In some embodiments, use of KEAP1 depletion, for example inhibition of expression of KEAP1 activity, is preferred. KEAP1 depletion may be achieved through siRNA, for example as shown in Orthwein et al. Alternatively, expression of the PALB2-KR mutant (lacking all eight Lys residues in the BRCA1-interaction domain) is preferred, either in combination with KEAP1 depletion or alone. PALB2-KR interacts with BRCA1 irrespective of cell cycle position. Thus, promotion or restoration of the BRCA1-PALB2 interaction, especially in G1 cells, is preferred in some embodiments, especially where the target cells are non-dividing, or where removal and return (ex vivo gene targeting) is problematic, for example neuron or muscle cells. KEAP1 siRNA is available from ThermoFischer. In some embodiments, a BRCA1-PALB2 complex may be delivered to the G1 cell. In some embodiments, PALB2 deubiquitylation may be promoted for example by increased expression of the deubiquitylase USP11, so it is envisaged that a construct may be provided to promote or up-regulate expression or activity of the deubiquitylase USP11.

Treating Diseases of the Eye

The present invention also contemplates delivering the CRISPR-Cas system to one or both eyes.

In particular embodiments of the invention, the CRISPR-Cas system may be used to correct ocular defects that arise from several genetic mutations further described in Genetic Diseases of the Eye, Second Edition, edited by Elias I. Traboulsi, Oxford University Press, 2012.

In some embodiments, the condition to be treated or targeted is an eye disorder. In some embodiments, the eye disorder may include glaucoma. In some embodiments, the eye disorder includes a retinal degenerative disease. In some embodiments, the retinal degenerative disease is selected from Stargardt disease, Bardet-Biedl Syndrome, Best disease, Blue Cone Monochromacy, Choroidermia, Cone-rod dystrophy, Congenital Stationary Night Blindness, Enhanced S-Cone Syndrome, Juvenile X-Linked Retinoschisis, Leber Congenital Amaurosis, Malattia Leventinesse, Norrie Disease or X-linked Familial Exudative Vitreoretinopathy, Pattern Dystrophy, Sorsby Dystrophy, Usher Syndrome, Retinitis Pigmentosa, Achromatopsia or Macular dystrophies or degeneration, Retinitis Pigmentosa, Achromatopsia, and age related macular degeneration. In some embodiments, the retinal degenerative disease is Leber Congenital Amaurosis (LCA) or Retinitis Pigmentosa. In some embodiments, the CRISPR system is delivered to the eye, optionally via intravitreal injection or subretinal injection.

For administration to the eye, lentiviral vectors, in particular equine infectious anemia viruses (EIAV), are particularly preferred.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285, Published online 21 Nov. 2005 in Wiley InterScience (interscience.wiley.com). DOI: 10.1002/jgm.845). The vectors are contemplated to have cytomegalovirus (CMV) promoter driving expression of the target gene. Intracameral, subretinal, intraocular and intravitreal injections are all contemplated (see, e.g., Balagaan, J Gene Med 2006; 8: 275-285, Published online 21 Nov. 2005 in Wiley InterScience (interscience.wiley.com). DOI: 10.1002/jgm.845). Intraocular injections may be performed with the aid of an operating microscope. For subretinal and intravitreal injections, eyes may be prolapsed by gentle digital pressure and fundi visualized using a contact lens system consisting of a drop of a coupling medium solution on the cornea covered with a glass microscope slide coverslip. For subretinal injections, the tip of a 10-mm 34-gauge needle, mounted on a 5-μl Hamilton syringe may be advanced under direct visualization through the superior equatorial sclera tangentially towards the posterior pole until the aperture of the needle was visible in the subretinal space. Then, 2 μl of vector suspension may be injected to produce a superior bullous retinal detachment, thus confirming subretinal vector administration. This approach creates a self-sealing sclerotomy allowing the vector suspension to be retained in the subretinal space until it is absorbed by the RPE, usually within 48 h of the procedure. This procedure may be repeated in the inferior hemisphere to produce an inferior retinal detachment. This technique results in the exposure of approximately 70% of neurosensory retina and RPE to the vector suspension. For intravitreal injections, the needle tip may be advanced through the sclera 1 mm posterior to the corneoscleral limbus and 2 μl of vector suspension injected into the vitreous cavity. For intracameral injections, the needle tip may be advanced through a corneoscleral limbal paracentesis, directed towards the central cornea, and 2 μl of vector suspension may be injected. For intracameral injections, the needle tip may be advanced through a corneoscleral limbal paracentesis, directed towards the central cornea, and 2 μl of vector suspension may be injected. These vectors may be injected at titers of either $1.0\text{-}1.4\times10^{10}$ or $1.0\text{-}1.4\times10^{9}$ transducing units (TU)/ml.

In another embodiment, RetinoStat®, an equine infectious anemia virus-based lentiviral gene therapy vector that expresses angiostatic proteins endostain and angiostatin that is delivered via a subretinal injection for the treatment of the web form of age-related macular degeneration, is also contemplated (see, e.g., Binley et al., HUMAN GENE THERAPY 23:980-991 (September 2012)). Such a vector may be modified for the CRISPR-Cas system of the present invention. Each eye may be treated with RetinoStat® at a dose of $1.1\times10^{5}$ transducing units per eye (TU/eye) in a total volume of 100 μl.

In another embodiment, an E1-, partial E3-, E4-deleted adenoviral vector may be contemplated for delivery to the eye. Twenty-eight patients with advanced neovascular age-related macular degeneration (AMD) were given a single intravitreous injection of an E1-, partial E3-, E4-deleted adenoviral vector expressing human pigment ep-ithelium-derived factor (AdPEDF.ll) (see, e.g., Campochiaro et al., Human Gene Therapy 17:167-176 (February 2006)). Doses ranging from 106 to 109.5 particle units (PU) were investigated and there were no serious adverse events related to AdPEDF.ll and no dose-limiting toxicities (see, e.g., Campochiaro et al., Human Gene Therapy 17:167-176 (February 2006)). Adenoviral vector mediated ocular gene transfer appears to be a viable approach for the treatment of ocular disorders and could be applied to the CRISPR Cas system.

In another embodiment, the sd-rxRNA® system of RXi Pharmaceuticals may be used/and or adapted for delivering CRISPR Cas to the eye. In this system, a single intravitreal administration of 3 μg of sd-rxRNA results in sequence-specific reduction of PPIB mRNA levels for 14 days. The sd-rxRNA® system may be applied to the nucleic acid-targeting system of the present invention, contemplating a dose of about 3 to 20 mg of CRISPR administered to a human.

Millington-Ward et al. (Molecular Therapy, vol. 19 no. 4, 642-649 April 2011) describes adeno-associated virus (AAV) vectors to deliver an RNA interference (RNAi)-based rhodopsin suppressor and a codon-modified rhodopsin replacement gene resistant to suppression due to nucleotide alterations at degenerate positions over the RNAi target site. An injection of either $6.0\times10^{8}$ vp or $1.8\times10^{10}$ vp AAV were subretinally injected into the eyes by Millington-Ward et al. The AAV vectors of Millington-Ward et al. may be applied to the CRISPR Cas system of the present invention, contemplating a dose of about $2\times10^{11}$ to about $6\times10^{13}$ vp administered to a human.

Dalkara et al. (Sci Transl Med 5, 189ra76 (2013)) also relates to in vivo directed evolution to fashion an AAV vector that delivers wild-type versions of defective genes throughout the retina after noninjurious injection into the eyes' vitreous humor. Dalkara describes a 7mer peptide display library and an AAV library constructed by DNA shuffling of cap genes from AAV1, 2, 4, 5, 6, 8, and 9. The rcAAV libraries and rAAV vectors expressing GFP under a CAG or Rho promoter were packaged and deoxyribonuclease-resistant genomic titers were obtained through quantitative PCR. The libraries were pooled, and two rounds of evolution were performed, each consisting of initial library diversification followed by three in vivo selection steps. In each such step, P30 rho-GFP mice were intravitreally injected with 2 ml of iodixanol-purified, phosphate-buffered saline (PBS)-dialyzed library with a genomic titer of about $1\times10^{12}$ vg/ml. The AAV vectors of Dalkara et al. may be applied to the nucleic acid-targeting system of the present invention, contemplating a dose of about $1\times10^{15}$ to about $1\times10^{16}$ vg/ml administered to a human.

In a particular embodiment, the rhodopsin gene may be targeted for the treatment of retinitis pigmentosa (RP), wherein the system of US Patent Publication No. 20120204282 assigned to Sangamo BioSciences, Inc. may be modified in accordance with the CRISPR Cas system of the present invention. In another embodiment, the methods of US Patent Publication No. 20130183282 assigned to Cellectis, which is directed to methods of cleaving a target sequence from the human rhodopsin gene, may also be modified to the nucleic acid-targeting system of the present invention. In another embodiment, the methods of US Publication No. 20150252358 assigned to Editas Medicine, which is directed to CRISPR-Cas related methods and compositions for treating leber's congenital amaurosis 10 (Lca10), may also be modified to the nucleic acid-targeting system for the present invention.

In another embodiment, the methods of US Patent Publication No. 20170073674 assigned to Editas Medicine, which is directed to CRISPR-Cas related methods and compositions for treating usher syndrome and retinitis pigmentosa, may also be modified to the nucleic acid targeting system for the present invention.

In some embodiments, the CRISPR protein is a C2c1, and the system comprises: I. a CRISPR-Cas system RNA polynucleotide sequence, wherein the polynucleotide sequence comprises: (a) a tracr RNA polynucleotide and a guide RNA polynucleotide capable of hybridizing to a target sequence, and (b) a direct repeat RNA polynucleotide, and II. a polynucleotide sequence encoding the C2c1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence, and the polynucleotide sequence encoding a CRISPR protein is DNA or RNA.

In certain embodiments, the C2c1 effector protein recognizes T-rich PAMs. In particular embodiments, the PAM is 5'-TTN-3' or 5'-ATTN-3'. In certain embodiments, the locus of interest related to MPS I is modified by the CRISPR-C2c1 complex by creating staggered cuts with 5' overhangs. In some embodiments, the 5' overhang is 7 nt. In some embodiments, the staggered cuts are followed by NHEJ or HDR. In certain embodiments, the locus of interest is modified by the CRISPR-C2c1 complex by inserting, or "knocking-in" a template DNA sequence. In particular embodiments, the DNA insert is designed to integrate into the genome in the proper orientation. Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic L02 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage.

Wu (Cell Stem Cell, 13:659-62, 2013) designed a guide RNA that led Cas9 to a single base pair mutation that causes cataracts in mice, where it induced DNA cleavage. Then using either the other wild-type allele or oligos given to the zygotes repair mechanisms corrected the sequence of the broken allele and corrected the cataract-causing genetic defect in mutant mouse.

US Patent Publication No. 20120159653 describes use of zinc finger nucleases to genetically modify cells, animals and proteins associated with macular degredation (MD). Macular degeneration (MD) is the primary cause of visual impairment in the elderly, but is also a hallmark symptom of childhood diseases such as Stargardt disease, Sorsby fundus, and fatal childhood neurodegenerative diseases, with an age of onset as young as infancy. Macular degeneration results in a loss of vision in the center of the visual field (the macula) because of damage to the retina. Currently existing animal models do not recapitulate major hallmarks of the disease as it is observed in humans. The available animal models comprising mutant genes encoding proteins associated with MD also produce highly variable phenotypes, making translations to human disease and therapy development problematic.

One aspect of US Patent Publication No. 20120159653 relates to editing of any chromosomal sequences that encode proteins associated with MD which may be applied to the nucleic acid-targeting system of the present invention. The proteins associated with MD are typically selected based on an experimental association of the protein associated with MD to an MD disorder. For example, the production rate or circulating concentration of a protein associated with MD may be elevated or depressed in a population having an MD disorder relative to a population lacking the MD disorder. Differences in protein levels may be assessed using proteomic techniques including, but not limited to, Western blot, immunohistochemical staining, enzyme linked immunosorbent assay (ELISA), and mass spectrometry. Alternatively, the proteins associated with MD may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR).

By way of non-limiting example, proteins associated with MD include, but are not limited, to the following proteins: (ABCA4) ATP-binding cassette, sub-family A (ABC1), member 4 ACHM1 achromatopsia (rod monochromacy) 1 ApoE Apolipoprotein E (ApoE) C1QTNF5 (CTRP5) C1q and tumor necrosis factor related protein 5 (C1QTNF5) C2 Complement component 2 (C2) C3 Complement components (C3) CCL2 Chemokine (C-C motif) Ligand 2 (CCL2) CCR2 Chemokine (C-C motif) receptor 2 (CCR2) CD36 Cluster of Differentiation 36 CFB Complement factor B CFH Complement factor CFH H CFHR1 complement factor H-related 1 CFHR3 complement factor H-related 3 CNGB3 cyclic nucleotide gated channel beta 3 CP ceruloplasmin (CP) CRP C reactive protein (CRP) CST3 cystatin C or cystatin 3 (CST3) CTSD Cathepsin D (CTSD) CX3CR1 chemokine (C-X3-C motif) receptor 1 ELOVL4 Elongation of very long chain fatty acids 4 ERCC6 excision repair crosscomplementing rodent repair deficiency, complementation group 6 FBLN5 Fibulin-5 FBLN5 Fibulin 5 FBLN6 Fibulin 6 FSCN2 fascin (FSCN2) HMCN1 Hemicentrin 1 HMCN1 hemicentin 1 HTRA1 HtrA serine peptidase 1 (HTRA1) HTRA1 HtrA serine peptidase 1 IL-6 Interleukin 6 IL-8 Interleukin 8 LOC387715 Hypothetical protein PLEKHA1 Pleckstrin homology domain containing family A member 1 (PLEKHA1) PROM1 Prominin 1 (PROM1 or CD133) PRPH2 Peripherin-2 RPGR retinitis pigmentosa GTPase regulator SERPINGI serpin peptidase inhibitor, clade G, member 1 (C1-inhibitor) TCOF1 Treacle TIMP3 Metalloproteinase inhibitor 3 (TIMP3) TLR3 Toll-like receptor 3.

The identity of the protein associated with MD whose chromosomal sequence is edited can and will vary. In preferred embodiments, the proteins associated with MD whose chromosomal sequence is edited may be the ATP-binding cassette, sub-family A (ABC1) member 4 protein (ABCA4) encoded by the ABCR gene, the apolipoprotein E protein (APOE) encoded by the APOE gene, the chemokine (C-C motif) Ligand 2 protein (CCL2) encoded by the CCL2 gene, the chemokine (C-C motif) receptor 2 protein (CCR2) encoded by the CCR2 gene, the ceruloplasmin protein (CP) encoded by the CP gene, the cathepsin D protein (CTSD) encoded by the CTSD gene, or the metalloproteinase inhibitor 3 protein (TIMP3) encoded by the TIMP3 gene. In an exemplary embodiment, the genetically modified animal is a rat, and the edited chromosomal sequence encoding the protein associated with MD may be: (ABCA4) ATPbinding cassette, NM_000350 sub-family A (ABC1), member 4 APOE Apolipoprotein E NM_138828 (APOE) CCL2 Chemokine (C-C NM_031530 motif) Ligand 2 (CCL2) CCR2 Chemokine (C-C NM_021866 motif) receptor 2 (CCR2) CP ceruloplasmin (CP) NM_012532 CTSD Cathepsin D (CTSD) NM_134334 TIMP3 Metalloproteinase NM_012886 inhibitor 3 (TIMP3). The animal or cell may comprise 1, 2, 3, 4, 5, 6, 7 or more disrupted chromosomal sequences encoding a protein associated with MD and zero, 1, 2, 3, 4, 5, 6, 7 or more chromosomally integrated sequences encoding the disrupted protein associated with MD.

The edited or integrated chromosomal sequence may be modified to encode an altered protein associated with MD. Several mutations in MD-related chromosomal sequences have been associated with MD. Non-limiting examples of mutations in chromosomal sequences associated with MD include those that may cause MD including in the ABCR protein, E471K (i.e., glutamate at position 471 is changed to lysine), R1 129L (i.e., arginine at position 1129 is changed to leucine), T1428M (i.e., threonine at position 1428 is changed to methionine), R1517S (i.e., arginine at position 1517 is changed to serine), I1562T (i.e., isoleucine at position 1562 is changed to threonine), and G1578R (i.e., glycine at position 1578 is changed to arginine); in the CCR2 protein, V64I (i.e., valine at position 192 is changed to isoleucine); in CP protein, G969B (i.e., glycine at position 969 is changed to asparagine or aspartate); in TIMP3 protein, S156C (i.e., serine at position 156 is changed to cysteine), G166C (i.e., glycine at position 166 is changed to cysteine), G167C (i.e., glycine at position 167 is changed to cysteine), Y168C (i.e., tyrosine at position 168 is changed to cysteine), S170C (i.e., serine at position 170 is changed to cysteine), Y172C (i.e., tyrosine at position 172 is changed to cysteine) and S181C (i.e., serine at position 181 is changed to cysteine). Other associations of genetic variants in MD-associated genes and disease are known in the art.

CRISPR systems are useful to correct diseases resulting from autosomal dominant genes. For example, CRISPR/Cas9 was used to remove an autosomal dominant gene that causes receptor loss in the eye. Bakondi, B. et al., In Vivo CRISPR/Cas9 Gene Editing Corrects Retinal Dystrophy in the S334ter-3 Rat Model of Autosomal Dominant Retinitis Pigmentosa. Molecular Therapy, 2015; DOI: 10.1038/mt.2015.220.

A person with ordinary skill in the art may use the method disclosed herein in a system similar as above described with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Treating Circulatory and Muscular Diseases

The present invention also contemplates delivering the CRISPR-Cas system described herein, e.g., C2c1 effector protein systems, to the heart. For the heart, a myocardium tropic adeno-associated virus (AAVM) is preferred, in particular AAVM41 which showed preferential gene transfer in the heart (see, e.g., Lin-Yanga et al., PNAS, Mar. 10, 2009, vol. 106, no. 10). Administration may be systemic or local. A dosage of about 1-10×$10^{14}$ vector genomes is contemplated for systemic administration. See also, e.g., Eulalio et al. (2012) Nature 492: 376 and Somasuntharam et al. (2013) Biomaterials 34: 7790.

For example, US Patent Publication No. 20110023139, describes use of zinc finger nucleases to genetically modify cells, animals and proteins associated with cardiovascular disease. Cardiovascular diseases generally include high blood pressure, heart attacks, heart failure, and stroke and TIA. Any chromosomal sequence involved in cardiovascular disease or the protein encoded by any chromosomal sequence involved in cardiovascular disease may be utilized in the methods described in this disclosure. The cardiovascular-related proteins are typically selected based on an experimental association of the cardiovascular-related protein to the development of cardiovascular disease. For example, the production rate or circulating concentration of a cardiovascular-related protein may be elevated or depressed in a population having a cardiovascular disorder relative to a population lacking the cardiovascular disorder. Differences in protein levels may be assessed using proteomic techniques including, but not limited to, Western blot, immunohistochemical staining, enzyme linked immunosorbent assay (ELISA), and mass spectrometry. Alternatively, the cardiovascular-related proteins may be identified by obtaining gene expression profiles of the genes encoding the proteins using genomic techniques including, but not limited to, DNA microarray analysis, serial analysis of gene expression (SAGE), and quantitative real-time polymerase chain reaction (Q-PCR).

By way of example, the chromosomal sequence may comprise, but is not limited to, IL1B (interleukin 1, beta), XDH (xanthine dehydrogenase), TP53 (tumor protein p53), PTGIS (prostaglandin 12 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin 12 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (*C. elegans*)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), VWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein 111a, antigen CD61)), CAT (catalase), UTS2 (urotensin 2), THBD (thrombomodulin), F10 (coagulation factor X), CP (ceruloplasmin (ferroxidase)), TNFRSF11B (tumor necrosis factor receptor superfamily, member 11b), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, subfamily B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-1-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CABIN1 (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SP1 (Sp1 transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member A1), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IL17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, A1 polypeptide), TTR (transthyretin), FABP4 (fatty acid binding protein 4, adipocyte), PON3 (paraoxonase 3), APOC1 (apolipoprotein C-I), INSR (insulin receptor), TNFRSF1B (tumor necrosis factor receptor superfamily, member 1B), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (*Drosophila*)), UGT1A1 (UDP glucuronosyltransferase 1 family, polypeptide A1), IFNA1 (interferon, alpha 1), PPARD (peroxisome proliferator-activated receptor delta), SIRT1 (sirtuin (silent mating type information regulation 2 homolog) 1 (*S. cerevisiae*)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gpl30, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF 11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member A1 (aldehyde reductase)), ALDH9A1 (aldehyde dehydrogenase 9 family, member A1), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin L1), PCNA (proliferating cell nuclear antigen), IGF2 (insulin-like growth factor 2 (somatomedin A)), ITGB1 (integrin, beta 1 (fibronectin receptor, beta polypeptide, antigen CD29 includes MDF2, MSK12)), CAST (calpastatin), CXCL 12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C-C motif) ligand 5), IRF1 (interferon regulatory factor 1), CFLAR (CASP8 and FADD-like apoptosis regulator), CALCA (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PECAM1 (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (*S. cerevisiae*)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-.beta.-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (B321 placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene C4 synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase 1B (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor H1), NR112 (nuclear receptor subfamily 1, group I, member 2), CRH (corticotropin releasing hormone), HTR1A (5-hydroxytryptamine (serotonin) receptor IA), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCHE (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase kinase 5), CHGA (chromogranin A (parathyroid secretory protein 1)), IAPP (islet amyloid polypeptide), RHO (rhodopsin), ENPP1 (ectonucleotide pyrophosphatase/phosphodiesterase 1), PTHLH (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha-), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISH (cytokine inducible SH2-containing protein), GAST (gastrin), MYOC (myocilin, trabecular meshwork inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), HSF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTH (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOH (apolipoprotein H (beta-2-glycoprotein I)), S100A8 (S100 calcium binding protein A8), IL11 (interleukin 11), ALOX15 (arachidonate 15-lipoxygenase), FBLN1 (fibulin 1), NR1H3 (nuclear receptor subfamily 1, group H, member 3), SCD (stearoyl-CoA desaturase (delta-9-desaturase)), GIP (gastric inhibitory polypeptide), CHGB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), HSD11B2 (hydroxysteroid (11-beta) dehydrogenase 2), CALCRL (calcitonin receptor-like), GALNT2 (UDP-N-acetyl-alpha-D-galactosamine.polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adenovirus E1B 19 kDa interacting protein 3), GCKR (glucokinase (hexokinase 4) regulator), S100A12 (S100 calcium binding protein A12), PADI4 (peptidyl arginine deiminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), IDDM2 (insulin-dependent diabetes mellitus 2), RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNAlC (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol (myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member B1), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), F11R (F11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), KHK (ketohexokinase (fructokinase)), SAT1 (spermidine/spermine N1-acetyltransferase 1), GGH (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RHOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-Sep (15 kDa selenoprotein), CILP2 (cartilage intermediate layer protein 2), TERC (telomerase RNA component), GGT2 (gamma-glutamyltransferase 2), MT-CO1 (mitochondrially encoded cytochrome c oxidase I), and UOX (urate oxidase, pseudogene). Any of these sequences, may be a target for the CRISPR-Cas system, e.g., to address mutation.

In an additional embodiment, the chromosomal sequence may further be selected from Pon1 (paraoxonase 1), LDLR (LDL receptor), ApoE (Apolipoprotein E), Apo B-100 (Apolipoprotein B-100), ApoA (Apolipoprotein(a)), ApoA1 (Apolipoprotein A1), CBS (Cystathione B-synthase), Glycoprotein IIb/IIb, MTHRF (5,10-methylenetetrahydrofolate reductase (NADPH), and combinations thereof. In one iteration, the chromosomal sequences and proteins encoded by chromosomal sequences involved in cardiovascular disease may be chosen from Cacna1C, Sod1, Pten, Ppar(alpha), Apo E, Leptin, and combinations thereof as target(s) for the CRISPR-Cas system.

A person with ordinary skill in the art may use the method disclosed herein in a system similar to the methods as above described with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Treating Diseases of the Liver and Kidney

The present invention also contemplates delivering the CRISPR-Cas system described herein, e.g., C2c1 effector protein systems, to the liver and/or kidney. Delivery strategies to induce cellular uptake of the therapeutic nucleic acid include physical force or vector systems such as viral-, lipid- or complex-based delivery, or nanocarriers. From the initial applications with less possible clinical relevance, when nucleic acids were addressed to renal cells with hydrodynamic high pressure injection systemically, a wide range of gene therapeutic viral and non-viral carriers have been applied already to target posttranscriptional events in different animal kidney disease models in vivo (Csaba Revesz and Peter Hamar (2011). Delivery Methods to Target RNAs in the Kidney, Gene Therapy Applications, Prof. Chunsheng Kang (Ed.), ISBN: 978-953-307-541-9, InTech, Available from: intechopen.com/books/gene-therapy-applications/delivery-methods-to-target-rnas-inthe-kidney). Delivery methods to the kidney may include those in Yuan et al. (Am J Physiol Renal Physiol 295: F605-F617, 2008). Yuan et al. investigated whether in vivo delivery of small interfering RNAs (siRNAs) targeting the 12/15-lipoxygenase (12/15-LO) pathway of arachidonate acid metabolism can ameliorate renal injury and diabetic nephropathy (DN) in a streptozotocininjected mouse model of type 1 diabetes. To achieve greater in vivo access and siRNA expression in the kidney, Yuan et al. used double-stranded 12/15-LO siRNA oligonucleotides conjugated with cholesterol. About 400 μg of siRNA was injected subcutaneously into mice. The method of Yuang et al. may be applied to the CRISPR Cas system of the present invention contemplating a 1-2 g subcutaneous injection of CRISPR Cas conjugated with cholesterol to a human for delivery to the kidneys.

Molitoris et al. (J Am Soc Nephrol 20: 1754-1764, 2009) exploited proximal tubule cells (PTCs) as the site of oligonucleotide reabsorption within the kidney to test the efficacy of siRNA targeted to p53, a pivotal protein in the apoptotic pathway, to prevent kidney injury. Naked synthetic siRNA to p53 injected intravenously 4 h after ischemic injury maximally protected both PTCs and kidney function. Molitoris et al.'s data indicates that rapid delivery of siRNA to proximal tubule cells follows intravenous administration. For dose-response analysis, rats were injected with doses of siP53, 0.33; 1, 3, or 5 mg/kg, given at the same four time points, resulting in cumulative doses of 1.32; 4, 12, and 20 mg/kg, respectively. All siRNA doses tested produced a SCr reducing effect on day one with higher doses being effective over approximately five days compared with PBS-treated ischemic control rats. The 12 and 20 mg/kg cumulative doses provided the best protective effect. The method of Molitoris et al. may be applied to the nucleic acid-targeting system of the present invention contemplating 12 and 20 mg/kg cumulative doses to a human for delivery to the kidneys.

Thompson et al. (Nucleic Acid Therapeutics, Volume 22, Number 4, 2012) reports the toxicological and pharmacokinetic properties of the synthetic, small interfering RNA I5NP following intravenous administration in rodents and nonhuman primates. I5NP is designed to act via the RNA interference (RNAi) pathway to temporarily inhibit expression of the pro-apoptotic protein p53 and is being developed to protect cells from acute ischemia/reperfusion injuries such as acute kidney injury that can occur during major cardiac surgery and delayed graft function that can occur following renal transplantation. Doses of 800 mg/kg I5NP in rodents, and 1,000 mg/kg I5NP in nonhuman primates, were required to elicit adverse effects, which in the monkey were isolated to direct effects on the blood that included a sub-clinical activation of complement and slightly increased clotting times. In the rat, no additional adverse effects were observed with a rat analogue of I5NP, indicating that the effects likely represent class effects of synthetic RNA duplexes rather than toxicity related to the intended pharmacologic activity of I5NP. Taken together, these data support clinical testing of intravenous administration of I5NP for the preservation of renal function following acute ischemia/reperfusion injury. The no observed adverse effect level (NOAEL) in the monkey was 500 mg/kg. No effects on cardiovascular, respiratory, and neurologic parameters were observed in monkeys following i.v. administration at dose levels up to 25 mg/kg. Therefore, a similar dosage may be contemplated for intravenous administration of CRISPR Cas to the kidneys of a human.

Shimizu et al. (J Am Soc Nephrol 21: 622-633, 2010) developed a system to target delivery of siRNAs to glomeruli via poly(ethylene glycol)-poly(L-lysine)-based vehicles. The siRNA/nanocarrier complex was approximately 10 to 20 nm in diameter, a size that would allow it to move across the fenestrated endothelium to access the mesangium. After intraperitoneal injection of fluorescence-labeled siRNA/nanocarrier complexes, Shimizu et al. detected siRNAs in the blood circulation for a prolonged time. Repeated intraperitoneal administration of a mitogen-activated protein kinase 1 (MAPK1) siRNA/nanocarrier complex suppressed glomerular MAPK1 mRNA and protein expression in a mouse model of glomerulonephritis. For the investigation of siRNA accumulation, Cy5-labeled siRNAs complexed with PIC nanocarriers (0.5 ml, 5 nmol of siRNA content), naked Cy5-labeled siRNAs (0.5 ml, 5 nmol), or Cy5-labeled siRNAs encapsulated in HVJ-E (0.5 ml, 5 nmol of siRNA content) were administrated to BALBc mice. The method of Shimizu et al. may be applied to the nucleic acid-targeting system of the present invention contemplating a dose of about of 10-20 mol CRISPR Cas complexed with nanocarriers in about 1-2 liters to a human for intraperitoneal administration and delivery to the kidneys.

A person with ordinary skill in the art may use the method disclosed herein with methods as described in Shimizu et al., Thompson et al., and Molitoris et al. with the C2c1-CRISPR system as disclosed herein. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Delivery Methods to the Kidney are Summarized as Follows:

| Delivery method | Carrier | Target RNA | Disease | Model | Functional assays | Author |
|---|---|---|---|---|---|---|
| Hydrodynamic/ Lipid | TransIT In Vivo Gene Delivery System, DOTAP | p85α | Acute renal injury | Ischemia-reperfusion | Uptake, biodistribution | Larson et al., Surgery, (August 2007), Vol. 142, No. 2, pp. (262-269) |
| Hydrodynamic/ Lipid | Lipofectamine 2000 | Fas | Acute renal injury | Ischemia-reperfusion | Blood urea nitrogen, Fas Immunohistochemistry, apoptosis, histological scoring | Hamar et al., Proc Natl Acad Sci, (October 2004), Vol. 101, No. 41, pp. (14883-14888) |
| Hydrodynamic | n.a. | Apoptosis cascade elements | Acute renal injury | Ischemia-reperfusion | n.a. | Zheng et al., Am J Pathol, (October 2008), Vol. 173, No. 4, pp. (973-980) |
| Hydrodynamic | n.a. | Nuclear factor kappa-b (NFkB) | Acute renal injury | Ischemia-reperfusion | n.a. | Feng et al., Transplantation, (May 2009), Vol. 87, No. 9, pp. (1283-1289) |
| Hydrodynamic/ Viral | Lipofectamine 2000 | Apoptosis antagonizing transcription factor (AATF) | Acute renal injury | Ischemia-reperfusion | Apoptosis, oxidative stress, caspase activation, membrane lipid peroxidation | Xie & Guo, Am Soc Nephrol, (December 2006), Vol. 17, No. 12, pp. (3336-3346) |
| Hydrodynamic | pBAsi mU6 Neo/TransIT-EE Hydrodynamic Delivery System | Gremlin | Diabetic nephropathy | Streptozotozin-induced diabetes | Proteinuria, serum creatinine, glomerular and tubular diameter, collagen type IV/ BMP7 expression | Q. Zhang et al., PloS ONE, (July 2010), Vol. 5, No. 7, e11709, pp. (1-13) |
| Viral/Lipid | pSUPER vector/ Lipofectamine | TGF-β type II receptor | Interstitial renal fibrosis | Unilateral urethral obstruction | α-SMA expression, collagen content, | Kushibikia et al., J Controlled Release, (July 2005), Vol. 105, No. 3, pp. (318-331) |
| Viral | Adeno-associated virus-2 | Mineral corticoid receptor | Hyper-tension caused renal damage | Cold-induced hypertension | blood pressure, serum albumin, serum urea nitrogen, serum creatinine, kidney weight, urinary sodium | Wang et al., Gene Therapy, (July 2006), Vol. 13, No. 14, pp. (1097-1103) |
| Hydrodynamic/ Viral | pU6 vector | Luciferase | n.a. | n.a. | uptake | Kobayashi et al., Journal of Pharmacology and Experimental Therapeutics, (February 2004), Vol. 308, No. 2, pp. (688-693) |
| Lipid | Lipoproteins, albumin | apoB1, apoM | n.a. | n.a. | Uptake, binding affinity to lipoproteins and albumin | Wolfrum et al., Nature Biotechnology, (September 2007), Vol. 25, No. 10, pp. (1149-1157) |

-continued

| Delivery method | Carrier | Target RNA | Disease | Model | Functional assays | Author |
|---|---|---|---|---|---|---|
| Lipid | Lipofectamine 2000 | p53 | Acute renal injury | Ischemic and cisplatin-induced acute injury | Histological scoring, apoptosis | Molitoris et al., J Am Soc Nephrol, (August 2009), Vol. 20, No. 8, pp. (1754-1764) |
| Lipid | DOTAP/DOPE, DOTAP/DOPE/DOPE-PEG2000 | COX-2 | Breast adeno-carcinoma | MDA-MB-231 breast cancer xenograft-bearing mouse | Cell viability, uptake | Mikhaylova et al., Cancer Gene Therapy, (March 2011), Vol. 16, No. 3, pp. (217-226) |
| Lipid | Cholesterol | 12/15-lipoxygenase | Diabetic nephro-pathy | Streptozotocin-induced diabetes | Albuminuria, urinary creatinine, histology, type I and IV collagen, TGF-β, fibronectin, plasminogen activator inhibitor 1 | Yuan et al., Am J Physiol Renal Physiol, (June 2008), Vol. 295, pp. (F605-F617) |
| Lipid | Lipofectamine 2000 | Mitochondrial membrane 44 (TIM44) | Diabetic nephro-pathy | Streptozotocin - induced diabetes | Cell proliferation and apoptosis, histology, ROS, mitochondrial import of Mn-SOD and glutathione peroxidase, cellular membrane polarization | Y. Zhang et al., J Am Soc Nephrol, (April 2006), Vol. 17, No. 4, pp. (1090-1101) |
| Hydrodynamic/Lipid | Proteolipo-some | RLIP76 | Renal carcinoma | Caki-2 kidney cancer xenograft-bearing mouse | uptake | Singhal et al., Cancer Res, (May 2009), Vol. 69, No. 10, pp. (4244-4251) |
| Polymer | PEGylated PEI | Luciferase pGL3 | n.a. | n.a. | Uptake, biodistribution, erythrocyte aggregation | Malek et al., Toxicology and Applied Pharmacology, (April 2009), Vol. 236, No. 1, pp. (97-108) |
| Polymer | PEGylated poly-L-lysine | MAPK1 | Lupus glomerulo-nephritis | Glomerulo-nephritis | Proteinuria, glomerulo-sclerosis, TGF-β, fibronectin, plasminogen activator inhibitor 1 | Shimizu et al., J Am Soc Nephrology, (April 2010), Vol. 21, No. 4, pp. (622-633) |
| Polymer/Nano particle | Hyaluronic acid/Quantum dot/PEI | VEGF | Kidney cancer/ melanoma | B16F1 melanoma tumor-bearing mouse | Biodistribution, citotoxicity, tumor volume, endocytosis | Jiang et al., Molecular Pharmaceutics, (May-June 2009), Vol. 6, No. 3, pp. (727-737) |
| Polymer/Nano particle | PEGylated polycapro-lactone nanofiber | GAPDH | n.a. | n.a. | cell viability, uptake | Cao et al, J Controlled Release, (June 2010), Vol. 144, No. 2, pp. (203-212) |
| Aptamer | Spiegelmer mNOX-E36 | CC chemokine ligand 2 | Glomerulo sclerosis | Uninephrecto-mized mouse | urinary albumin, urinary creatinine, histopathology, glomerular filtration rate, macrophage count, serum Ccl2, Mac-2+, Ki-67+ | Ninichuk et al., Am J Pathol, (March 2008), Vol. 172, No. 3, pp. (628-637) |
| Aptamer | Aptamer NOX-F37 | vasopressin (AVP) | Congestive heart failure | n.a. | Binding affinity to D-AVP, Inhibition of AVP Signaling, Urine osmolality and sodium concentration, | Purschke et al., Proc Natl Acad Sci, (March 2006), Vol. 103, No. 13, pp. (5173-5178) |

Targeting the Liver or Liver Cells

Targeting liver cells is provided. This may be in vitro or in vivo. Hepatocytes are preferred. Delivery of the CRISPR protein, such as C2c1 herein may be via viral vectors, especially AAV (and in particular AAV2/6) vectors. These may be administered by intravenous injection.

A preferred target for liver, whether in vitro or in vivo, is the albumin gene. This is a so-called 'safe harbor" as albumin is expressed at very high levels and so some reduction in the production of albumin following successful gene editing is tolerated. It is also preferred as the high levels of expression seen from the albumin promoter/enhancer allows for useful levels of correct or transgene production (from the inserted donor template) to be achieved even if only a small fraction of hepatocytes are edited.

Intron 1 of albumin has been shown by Wechsler et al. (reported at the 57th Annual Meeting and Exposition of the American Society of Hematology—abstract available online at ash.confex.com/ash/2015/webprogram/Paper86495.html and presented on 6 Dec. 2015) to be a suitable target site. Their work used Zn Fingers to cut the DNA at this target site, and suitable guide sequences can be generated to guide cleavage at the same site by a CRISPR protein.

The use of targets within highly-expressed genes (genes with highly active enhancers/promoters) such as albumin may also allow a promoterless donor template to be used, as reported by Wechsler et al. and this is also broadly applicable outside liver targeting. Other examples of highly-expressed genes are known.

Other Disease of the Liver

In particular embodiments, the CRISPR proteins of the present invention are used in the treatment of liver disorders such as transthyretin amyloidosis (ATTR), alpha-1 antitrypsin deficiency and other hepatic-based inborn errors of metabolism. FAP is caused by a mutation in the gene that encodes transthyretin (TTR). While it is an autosomal dominant disease, not all carriers develop the disease. There are over 100 mutations in the TTR gene known to be associated with the disease. Examples of common mutations include V30M. The principle of treatment of TTR based on gene silencing has been demonstrated by studies with iRNA (Ueda et al. 2014 Transl Neurogener. 3:19). Wilson's Disease (WD) is caused by mutations in the gene encoding ATP7B, which is found exclusively in the hepatocyte. There are over 500 mutations associated with WD, with increased prevalence in specific regions such as East Asia. Other examples are A1ATD (an autosomal recessive disease caused by mutations in the SERPINA1 gene) and PKU (an autosomal recessive disease caused by mutations in the phenylalanine hydroxylase (PAH) gene).

In one aspect, the present invention provides a method of treating liver disorders, comprising delivery to the cell a C2c1-CRIPSR system comprising a C2c1-CRISPR complexed with a tracr RNA, a guide RNA comprising a guide sequence and a direct repeat, wherein the guide sequence hybridizes with the target sequence of genes involved in liver disorders, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Liver-Associated Blood Disorders, Especially Hemophilia and in Particular Hemophilia B Successful gene editing of hepatocytes has been achieved in mice (both in vitro and in vivo) and in non-human primates (in vivo), showing that treatment of blood disorders through gene editing/genome engineering in hepatocytes is feasible. In particular, expression of the human F9 (hF9) gene in hepatocytes has been shown in non-human primates indicating a treatment for Hemophillia B in humans. In one aspect, the present invention provides a method of treating liver-associated blood disorders, comprising delivery to the cell a C2c1-CRIPSR system comprising a C2c1-CRISPR complexed with a tracr RNA, a guide RNA comprising a guide sequence and a direct repeat, wherein the guide sequence hybridizes with the target sequence of genes involved in liver disorders, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Wechsler et al. reported at the 57th Annual Meeting and Exposition of the American Society of Hematology (abstract presented 6 Dec. 2015 and available online at ash.confex.com/ash/2015/webprogram/Paper86495.html) that they have successfully expressed human F9 (hF9) from hepatocytes in non-human primates through in vivo gene editing. This was achieved using 1) two zinc finger nucleases (ZFNs) targeting intron 1 of the albumin locus, and 2) a human F9 donor template construct. The ZFNs and donor template were encoded on separate hepatotropic adeno-associated virus serotype 2/6 (AAV2/6) vectors injected intravenously, resulting in targeted insertion of a corrected copy of the hF9 gene into the albumin locus in a proportion of liver hepatocytes.

The albumin locus was selected as a "safe harbor" as production of this most abundant plasma protein exceeds 10 g/day, and moderate reductions in those levels are well-tolerated. Genome edited hepatocytes produced normal hFIX (hF9) in therapeutic quantities, rather than albumin, driven by the highly active albumin enhancer/promoter. Targeted integration of the hF9 transgene at the albumin locus and splicing of this gene into the albumin transcript was shown.

Mice studies: C57BL/6 mice were administered vehicle (n=20) or AAV2/6 vectors (n=25) encoding mouse surrogate reagents at $1.0\times10^{13}$ vector genome (vg)/kg via tail vein injection. ELISA analysis of plasma hFIX in the treated mice showed peak levels of 50-1053 ng/mL that were sustained for the duration of the 6-month study. Analysis of FIX activity from mouse plasma confirmed bioactivity commensurate with expression levels.

Non-human primate (NHP) studies: a single intravenous co-infusion of AAV2/6 vectors encoding the NHP targeted albumin-specific ZFNs and a human F9 donor at $1.2\times10^{13}$ vg/kg (n=5/group) resulted in >50 ng/mL (>1% of normal) in this large animal model. The use of higher AAV2/6 doses (up to 1.5×1014 vg/kg) yielded plasma hFIX levels up to 1000 ng/ml (or 20% of normal) in several animals and up to 2000 ng/ml (or 50% of normal) in a single animal, for the duration of the study (3 months).

The treatment was well tolerated in mice and NHPs, with no significant toxicological findings related to AAV2/6 ZFN+ donor treatment in either species at therapeutic doses. Sangamo (CA, USA) has since applied to the FDA, and been granted permission to conduct the world's first human clinical trial for an in vivo genome editing application. This follows on the back of the EMEA's approval of the Glybera gene therapy treatment of lipoprotein lipase deficiency.

Accordingly, it is preferred, in some embodiments, that any or all of the following are used: AAV (especially AAV2/6) vectors, preferably administered by intravenous injection; Albumin as target for gene editing/insertion of transgene/template-especially at intron 1 of albumin; human F9 donor template; and/or a promoterless donor template.

Hemophilia B

Accordingly, in some embodiments, it is preferred that the present invention is used to treat Hemophilia B. As such it is preferred that F9 (Factor IX) is targeted through provision of a suitable guide RNA. The enzyme and the guide may ideally be targeted to the liver where F9 is produced, although they can be delivered together or separately. A template is provided, in some embodiments, and that this is the human F9 gene. It will be appreciated that the hF9 template comprises the wt or 'correct' version of hF9 so that the treatment is effective. In some embodiments, a two-vector system may be used-one vector for the C2c1 and one vector for the repair template(s). The repair template may include two or more repair templates, for example, two F9 sequences from different mammalian species. In some embodiments, both a mouse and human F9 sequence are provided. This may be delivered to mice. Yang Yang, John White, McMenamin Deirdre, and Peter Bell, PhD, presenting at 58th Annual American Society of Hematology Meeting (November 2016), report that this increases potency and accuracy. The second vector inserted the human sequence of factor IX into the mouse genome. In some embodiments, the targeted insertion leads to the expression of a chimeric hyperactive factor IX protein. In some embodiments, this is under the control of the native mouse factor IX promoter. Injecting this two-component system (vector 1 and vector 2) into newborn and adult "knock-out" mice at increasing doses led to expression and activity of stable factor IX activity at normal (or even higher) levels for over four months. In the case of treating humans, a native human F9 promoter may be used instead. In some embodiments, the wt phenotype is restored.

In an alternative embodiment, the hemophilia B version of F9 may be delivered so as to create a model organism, cell or cell line (for example a murine or non-human primate model organism, cell or cell line), the model organism, cell or cell line having or carrying the Hemophilia B phenotype, i.e., an inability to produce wt F9.

Hemophilia A

In some embodiments, the F9 (factor IX) gene may be replaced by the F8 (factor VIII) gene described above, leading to treatment of Hemophilia A (through provision of a correct F8 gene) and/or creation of a Hemophilia A model organism, cell or cell line (through provision of an incorrect, Hemophilia A version of the F8 gene).

Hemophilia C

In some embodiments, the F9 (factor IX) gene may be replaced by the F11 (factor XI) gene described above, leading to treatment of Hemophilia C (through provision of a correct F11 gene) and/or creation of a Hemophilia C model organism, cell or cell line (through provision of an incorrect, Hemophilia C version of the F11 gene).

Transthyretin Amyloidosis

Transthyretin is a protein, mainly produced in the liver, present in the serum and CSF which carries thyroxin hormone and retinol binding protein bound to retinol (Vitamin A). Over 120 different mutations can cause Transthyretin amyloidosis (ATTR), a heritable genetic disorder wherein mutant forms of the protein aggregate in tissues, particularly the peripheral nervous system, causing polyneuropathy. Familial amyloid polyneuropathy (FAP) is the most common TTR disorder and, in 2014, was thought to affect 47 per 100,000 people in Europe. A mutation in the TTR gene of Val30Met is thought be the most common mutation, causing an estimated 50% of FAP cases. In the absence of a liver transplant, the only known cure to date, the disease is usually fatal within a decade of diagnosis. The majority of cases are monogenic.

In mouse models of ATTR, the TTR gene may be edited in a dose dependent manner by the delivery of CRISPR/Cas9. In some embodiments, the C2c1 is provided as mRNA. In some embodiments, C2c1 mRNA and guide RNA are packaged in LNPs. A system comprising C2c1 mRNA and guide RNA packaged in LNPs achieved up to 60% editing efficiency in the liver, with serum TTR levels being reduced by up to 80%. In some embodiments, therefore, Transthyretin is targeted, in particular correcting for the Val30Met mutation. In some embodiments, therefore, ATTR is treated.

Alpha-1 Antitrypsin Deficiency

Alpha-1 Antitrypsin (A1AT) is a protein produced in the liver which primarily functions to decrease the activity of neutrophil elastase, an enzyme which degrades connective tissue in the lungs. Alpha-1 Antitrypsin Deficiency (ATTD) is a disease caused by mutation of the SERPINA1 gene, which encodes A1AT. Impaired production of A1AT leads to a gradual degradation of the connective tissue of the lung resulting in emphysema like symptoms.

Several mutations can cause ATTD, though the most common mutations are Glu342Lys (referred to as Z allele, wild-type is referred to as M) or Glu264Val (referred to as the S allele), and each allele contributes equally to the disease state, with two affected alleles resulting in more pronounced pathophysiology. These results not only resulted in degradation of the connective tissue of sensitive organs, such as the lung, but accumulation of the mutants in the liver can result in proteotoxicity. Current treatments focus on the replacement of AAT by injection of protein retrieved from donated human plasma. In severe cases, a lung and/or liver transplant may be considered.

The common variants of the disease are again monogenic. In some embodiments, the SERPINA1 gene is targeted. In some embodiments, the Glu342Lys mutation (referred to as Z allele, wild-type is referred to as M) or the Glu264Val mutation (referred to as the S allele) are corrected for. In some embodiments, therefore, the faulty gene would require replacement by the wild-type functioning gene. In some embodiments, a knockout and repair approach is required, so a repair template is provided. In the case of bi-allelic mutations, in some embodiments only one guide RNA would be required for homozygous mutations, but in the case of heterozygous mutations two guide RNAs may be required. Delivery is, in some embodiments, to the lung or liver.

Inborn Errors of Metabolism

Inborn errors of metabolism (IEMs) are an umbrella group of diseases which affect metabolic processes. In some embodiments, an IEM is to be treated. The majority of these diseases are monogenic in nature (e.g., phenylketonuria) and the pathophysiology results from either the abnormal accumulation of substances which are inherently toxic, or mutations which result in an inability to synthesize essential substances. Depending on the nature of the IEM, CRISPR/C2c1 may be used to facilitate a knock-out alone, or in combination with replacement of a faulty gene via a repair template. Exemplary diseases that may benefit from CRISPR/C2c1 technology are, in some embodiments: primary hyperoxaluria type 1 (PH1), argininosuccinic lyase deficiency, ornithine transcarbamylase deficiency, phenylketonuria, or PKU, and maple syrup urine disease.

Treating Epithelial and Lung Diseases

The present invention also contemplates delivering the CRISPR-Cas system described herein, e.g., C2c1 effector protein systems, to one or both lungs.

Although AAV-2-based vectors were originally proposed for CFTR delivery to CF airways, other serotypes such as AAV-1, AAV-5, AAV-6, and AAV-9 exhibit improved gene transfer efficiency in a variety of models of the lung epithelium (see, e.g., Li et al., Molecular Therapy, vol. 17 no. 12, 2067-2077 December 2009). AAV-1 was demonstrated to be ~100-fold more efficient than AAV-2 and AAV-5 at transducing human airway epithelial cells in vitro, although AAV-1 transduced murine tracheal airway epithelia in vivo with an efficiency equal to that of AAV-5. Other studies have shown that AAV-5 is 50-fold more efficient than AAV-2 at gene delivery to human airway epithelium (HAE) in vitro and significantly more efficient in the mouse lung airway epithelium in vivo. AAV-6 has also been shown to be more efficient than AAV-2 in human airway epithelial cells in vitro and murine airways in vivo. The more recent isolate, AAV-9, was shown to display greater gene transfer efficiency than AAV-5 in murine nasal and alveolar epithelia in vivo with gene expression detected for over 9 months suggesting AAV may enable long-term gene expression in vivo, a desirable property for a CFTR gene delivery vector. Furthermore, it was demonstrated that AAV-9 could be readministered to the murine lung with no loss of CFTR expression and minimal immune consequences. CF and non-CF HAE cultures may be inoculated on the apical surface with 100 μl of AAV vectors for hours (see, e.g., Li et al., Molecular Therapy, vol. 17 no. 12, 2067-2077 December 2009). The MOI may vary from $1\times10^3$ to $4\times10^5$ vector genomes/cell, depending on virus concentration and purposes of the experiments. The above cited vectors are contemplated for the delivery and/or administration of the invention.

Zamora et al. (Am J Respir Crit Care Med Vol 183. pp 531-538, 2011) reported an example of the application of an RNA interference therapeutic to the treatment of human infectious disease and also a randomized trial of an antiviral drug in respiratory syncytial virus (RSV)-infected lung transplant recipients. Zamora et al. performed a randomized, double-blind, placebo-controlled trial in LTX recipients with RSV respiratory tract infection. Patients were permitted to receive standard of care for RSV. Aerosolized ALN-RSV01 (0.6 mg/kg) or placebo was administered daily for 3 days. This study demonstrates that an RNAi therapeutic targeting RSV can be safely administered to LTX recipients with RSV infection. Three daily doses of ALN-RSV01 did not result in any exacerbation of respiratory tract symptoms or impairment of lung function and did not exhibit any systemic proinflammatory effects, such as induction of cytokines or CRP. Pharmacokinetics showed only low, transient systemic exposure after inhalation, consistent with preclinical animal data showing that ALN-RSV01, administered intravenously or by inhalation, is rapidly cleared from the circulation through exonuclease mediated digestion and renal excretion. The method of Zamora et al. may be applied to the nucleic acid-targeting system of the present invention and an aerosolized CRISPR Cas, for example with a dosage of 0.6 mg/kg, may be contemplated for the present invention.

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector. In this instance, the following constructs are provided as examples: Cbh or EF1a promoter for Cas (C2c1), U6 or H1 promoter for guide RNA. A preferred arrangement is to use a CFTRdelta508 targeting guide, a repair template for deltaF508 mutation and a codon optimized C2c1 enzyme, with optionally one or more nuclear localization signal or sequence(s) (NLS(s)), e.g., two (2) NLSs. Constructs without NLS are also envisaged.

Treating Diseases of the Muscular System

The present invention also contemplates delivering the CRISPR-Cas system described herein, e.g., C2c1 effector protein systems, to muscle(s).

Bortolanza et al. (Molecular Therapy vol. 19 no. 11, 2055-2064 November 2011) shows that systemic delivery of RNA interference expression cassettes in the FRG1 mouse, after the onset of facioscapulohumeral muscular dystrophy (FSHD), led to a dose-dependent long-term FRG1 knockdown without signs of toxicity. Bortolanza et al. found that a single intravenous injection of 5×1012 vg of rAAV6-sh1FRG1 rescues muscle histopathology and muscle function of FRG1 mice. In detail, 200 μl containing 2×1012 or 5×1012 vg of vector in physiological solution were injected into the tail vein using a 25-gauge Terumo syringe. The method of Bortolanza et al. may be applied to an AAV expressing CRISPR Cas and injected into humans at a dosage of about 2×1015 or 2×1016 vg of vector.

Dumonceaux et al. (Molecular Therapy vol. 18 no. 5, 881-887 May 2010) inhibit the myostatin pathway using the technique of RNA interference directed against the myostatin receptor AcvRIIb mRNA (sh-AcvRIIb). The restoration of a quasi-dystrophin was mediated by the vectorized U7 exon-skipping technique (U7-DYS). Adeno-associated vectors carrying either the sh-AcvrIIb construct alone, the U7-DYS construct alone, or a combination of both constructs were injected in the tibialis anterior (TA) muscle of dystrophic mdx mice. The injections were performed with 1011 AAV viral genomes. The method of Dumonceaux et al. may be applied to an AAV expressing CRISPR Cas and injected into humans, for example, at a dosage of about 1014 to about 1015 vg of vector.

Kinouchi et al. (Gene Therapy (2008) 15, 1126-1130) report the effectiveness of in vivo siRNA delivery into skeletal muscles of normal or diseased mice through particle formation of chemically unmodified siRNAs with atelocollagen (ATCOL). ATCOL-mediated local application of siRNA targeting myostatin, a negative regulator of skeletal muscle growth, in mouse skeletal muscles or intravenously, caused a marked increase in the muscle mass within a few weeks after application. These results imply that ATCOL-mediated application of siRNAs is a powerful tool for future therapeutic use for diseases including muscular atrophy. MstsiRNAs (final concentration, 10 mM) were mixed with ATCOL (final concentration for local administration, 0.5%) (AteloGene, Kohken, Tokyo, Japan) according to the manufacturer's instructions. After anesthesia of mice (20-week-old male C57BL/6) by Nembutal (25 mg/kg, i.p.), the Mst-siRNA/ATCOL complex was injected into the masseter and biceps femoris muscles. The method of Kinouchi et al. may be applied to CRISPR Cas and injected into a human, for example, at a dosage of about 500 to 1000 ml of a 40 μM solution into the muscle. Hagstrom et al. (Molecular Therapy Vol. 10, No. 2, August 2004) describe an intravascular, nonviral methodology that enables efficient and repeatable delivery of nucleic acids to muscle cells (myofibers) throughout the limb muscles of mammals. The procedure involves the injection of naked plasmid DNA or siRNA into a distal vein of a limb that is transiently isolated by a tourniquet or blood pressure cuff. Nucleic acid delivery to myofibers is facilitated by its rapid injection in sufficient volume to enable extravasation of the nucleic acid solution into muscle tissue. High levels of transgene expression in skeletal muscle were achieved in both small and large animals with minimal toxicity. Evidence of siRNA delivery to limb muscle was also obtained. For plasmid DNA intravenous injection into a rhesus monkey, a three-way stopcock was connected to two syringe pumps (Model PHD 2000; Harvard Instruments), each loaded with a single syringe. Five minutes after a papaverine injection, pDNA (15.5 to 25.7 mg in 40-100 ml saline) was injected at a rate of 1.7 or 2.0 ml/s. This could be scaled up for plasmid DNA expressing CRISPR Cas of the present invention with an injection of about 300 to 500 mg in 800 to 2000 ml saline for a human. For adenoviral vector injections into a rat, 2×109 infectious particles were injected in 3 ml of normal saline solution (NSS). This could be scaled up for an adenoviral vector expressing CRISPR Cas of the present invention with an injection of about 1×1013 infectious particles were injected in 10 liters of NSS for a human. For siRNA, a rat was injected into the great saphenous vein with 12.5 μg of a siRNA and a primate was injected into the great saphenous vein with 750 μg of a siRNA. This could be scaled up for a CRISPR Cas of the present invention, for example, with an injection of about 15 to about 50 mg into the great saphenous vein of a human.

See also, for example, WO2013163628 A2, Genetic Correction of Mutated Genes, published application of Duke University describes efforts to correct, for example, a frameshift mutation which causes a premature stop codon and a truncated gene product that can be corrected via nuclease mediated non-homologous end joining such as those responsible for Duchenne Muscular Dystrophy, ("DMD") a recessive, fatal, X-linked disorder that results in muscle degeneration due to mutations in the dystrophin gene. The majority of dystrophin mutations that cause DMD are deletions of exons that disrupt the reading frame and cause premature translation termination in the dystrophin gene. Dystrophin is a cytoplasmic protein that provides structural stability to the dystroglycan complex of the cell membrane that is responsible for regulating muscle cell integrity and function. The dystrophin gene or "DMD gene" as used interchangeably herein is 2.2 megabases at locus Xp21. The primary transcription measures about 2,400 kb with the mature mRNA being about 14 kb. 79 exons code for the protein which is over 3500 amino acids. Exon 51 is frequently adjacent to frame-disrupting deletions in DMD patients and has been targeted in clinical trials for oligonucleotide-based exon skipping. A clinical trial for the exon 51 skipping compound eteplirsen recently reported a significant functional benefit across 48 weeks, with an average of 47% dystrophin positive fibers compared to baseline. Mutations in exon 51 are ideally suited for permanent correction by NHEJ-based genome editing.

The methods of US Patent Publication No. 20130145487 assigned to Cellectis, which relates to meganuclease variants to cleave a target sequence from the human dystrophin gene (DMD), may also be modified to for the nucleic acid-targeting system of the present invention. In preferred embodiments, the nucleic targeting system comprises a CRISPR-C2c1 system. With respect to the C2c1 protein the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Treating Diseases of the Skin

The present invention also contemplates delivering the CRISPR-Cas system described herein, e.g., C2c1 effector protein systems, to the skin.

Hickerson et al. (Molecular Therapy—Nucleic Acids (2013) 2, e129) relates to a motorized microneedle array skin delivery device for delivering self-delivery (sd)-siRNA to human and murine skin. The primary challenge to translating siRNA-based skin therapeutics to the clinic is the development of effective delivery systems. Substantial effort has been invested in a variety of skin delivery technologies with limited success. In a clinical study in which skin was treated with siRNA, the exquisite pain associated with the hypodermic needle injection precluded enrollment of additional patients in the trial, highlighting the need for improved, more "patient-friendly" (i.e., little or no pain) delivery approaches. Microneedles represent an efficient way to deliver large charged cargos including siRNAs across the primary barrier, the stratum corneum, and are generally regarded as less painful than conventional hypodermic needles. Motorized "stamp type" microneedle devices, including the motorized microneedle array (MMNA) device used by Hickerson et al., have been shown to be safe in hairless mice studies and cause little or no pain as evidenced by (i) widespread use in the cosmetic industry and (ii) limited testing in which nearly all volunteers found use of the device to be much less painful than a flushot, suggesting siRNA delivery using this device will result in much less pain than was experienced in the previous clinical trial using hypodermic needle injections. The MMNA device (marketed as Triple-M or Tri-M by Bomtech Electronic Co, Seoul, South Korea) was adapted for delivery of siRNA to mouse and human skin. sd-siRNA solution (up to 300 μl of 0.1 mg/ml RNA) was introduced into the chamber of the disposable Tri-M needle cartridge (Bomtech), which was set to a depth of 0.1 mm. For treating human skin, deidentified skin (obtained immediately following surgical procedures) was manually stretched and pinned to a cork platform before treatment. All intradermal injections were performed using an insulin syringe with a 28-gauge 0.5-inch needle. The MMNA device and method of Hickerson et al. could be used and/or adapted to deliver the CRISPR Cas of the present invention, for example, at a dosage of up to 300 μl of 0.1 mg/ml CRISPR Cas to the skin.

Leachman et al. (Molecular Therapy, vol. 18 no. 2, 442-446 February 2010) relates to a phase Ib clinical trial for treatment of a rare skin disorder pachyonychia congenita (PC), an autosomal dominant syndrome that includes a disabling plantar keratoderma, utilizing the first short-interfering RNA (siRNA)-based therapeutic for skin. This siRNA, called TD101, specifically and potently targets the keratin 6a (K6a) N171K mutant mRNA without affecting wild-type K6a mRNA.

Zheng et al. (PNAS, Jul. 24, 2012, vol. 109, no. 30, 11975-11980) show that spherical nucleic acid particle conjugates (SNA-NCs), gold cores surrounded by a dense shell of highly oriented, covalently immobilized siRNA, freely penetrate almost 100% of keratinocytes in vitro, mouse skin, and human epidermis within hours after application. Zheng et al. demonstrated that a single application of 25 nM epidermal growth factor receptor (EGFR) SNA-NCs for 60 h demonstrate effective gene knockdown in human skin. A similar dosage may be contemplated for CRISPR Cas immobilized in SNA-NCs for administration to the skin. The methods of Zheng et al., Leachman et al. and Hickerson et al. may also be modified to for the nucleic acid-targeting system of the present invention. In preferred embodiments, the nucleic targeting system comprises a CRISPR-C2c1 system. With respect to the C2c1 protein the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Cancer

In some embodiments, the treatment, prophylaxis or diagnosis of cancer is provided. The target is preferably one or more of the FAS, BID, CTLA4, PDCD1, CBLB, PTPN6, TRAC or TRBC genes. The cancer may be one or more of lymphoma, chronic lymphocytic leukemia (CLL), B cell acute lymphocytic leukemia (B-ALL), acute lymphoblastic leukemia, acute myeloid leukemia, non-Hodgkin's lymphoma (NHL), diffuse large cell lymphoma (DLCL), multiple myeloma, renal cell carcinoma (RCC), neuroblastoma, colorectal cancer, Castration resistant prostate cancer, Metastatic Renal Cell Carcinoma, metastatic Non-small cell lung cancer, breast cancer, bladder cancer, ovarian cancer, melanoma, sarcoma, prostate cancer, lung cancer, esophageal cancer, hepatocellular carcinoma, pancreatic cancer, astrocytoma, mesothelioma, head and neck cancer, and medulloblastoma. This may be implemented with engineered chimeric antigen receptor (CAR) T cell. This is described in WO2015161276, the disclosure of which is hereby incorporated by reference and described herein below.

Treatments of multiple cancer, including esophageal cancer, invasive bladder cancer, hormone refractory prostate cancer, metastatic renal cell carcinoma, metastatic non-small cell lung cancer, stage IV gastric carcinoma, stage IV nasopharynegeal carcinoma, stage IV t-cell lymphoma, and Epstei-Barr virus associated malignancies with a CRISPR-Cas9 system by generating PD-1 knock out T cells were proposed and described. See Niu et al. Cell 2014, 156(4): 836-43; Rosenberg et al, Science 2015, 348 (6230): 62-8; Sharma et al, Cell 2015, 161(2): 205-14; Bidnur et al, Bladder Cancer, 2016, 2(1): 15-25; Kim et al, Investig Clin Urol. 2016, 57 Suppl 1: S98-S105; Argon-Ching et al, Future Oncol., 2016, 12(17): 2049-58; Festino et al, Drugs 2016, 76(9): 925-45; Zibelman et al, Future Oncl., 2016, 12(19): 2227-42; Doni et al., J. Urol., 2017 197(1): 14-22; Yi et al, Biochim Biophys Acta., 2016, 1866(2): 197-207; Taube et al, Oncoimmunology, 2014, 3(11)L e963413; Yatsuda et al, Nihon Rinsho, 2014, 72(12): 2174-8; Modena et al. Oncol Rev. 2016, 10(1): 293; Bishop et al. Oncotarget, 2015, 6(1): 234-42; Gandini et al, Crit Rev Oncol Hematol. 2016, 100:88-98; Koshikin et al, Expert Opin Pharmacother. 2016 17(9):1225-32; Hofmann et al., Eur J Cancer. 2016, 60:190-209; Gunturi et al, Curr Treat Options Oncol. 2014, 15(1):137-46; Bockorny et al., Expert Opin Biol Ther. 2013, 13(6):911-25; Garon et al, N Engl J Med 2015, 372(21)L 2018-28; Brahmer et al, N Eng J Med, 2015 373(2): 123-35; Borghaei et al, N Engl JH Med 2015, 373(17): 1627-39; Kim et al, Gastroenterology, 2015 148(1): 137-147; Quan et al, PloS One, 2015, 10(9): 30136476; Louis et al, J Immunother., 2010, 33(9): 983-90; Lloyd et al., Frot Immunol., 2013, 4:221; Su et al, Sci Rep. 2016, 6: 20070. Peripheral blood lymphocytes will be collected and Programmed cell death protein 1 (PDCD1) gene will be knocked out by CRISPR Cas9 in the laboratory (PD-1 Knockout T cells). The lymphocytes are selected and expanded ex vivo and infused back into patients. A total of 2×10^7/kg PD-1 Knockout T cells are infused in one cycle. Each cycle is divided into three administrations, with 20% infused in the first administration, 30% in the second, and the remaining 50% in the third. For advanced esophageal cancer and invasive musule bladder cancer, cyclophosphamide at 20 mg/kg single dose are administered 3 days i.v. before cell infusion. Interleukin-2 (IL-2) are administered in the following 5 days, 720000 international unit (IU)/Kg/day (if tolerant). Patients receive a total of 2, 3, 4 cycles of treatment.

Target genes suitable for the treatment or prophylaxis of cancer may include, in some embodiments, those described in WO2015048577 the disclosure of which is hereby incorporated by reference. The methods of WO2015161276 and WO2015048577 may also be modified to for the nucleic acid-targeting system of the present invention.

The CRISPR-C2c1 system disclosed herein may be applied with methods described above in cancer treatment. In preferred embodiments, the nucleic targeting system comprises a CRISPR-C2c1 system. With respect to the C2c1 protein the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene. C2c1 creates double strand breaks at the distal end of PAM, in contrast to cleavage at the proximal end of PAM created by Cas9 (Jinek et al., 2012; Cong et al., 2013). It is proposed that C2c1 mutated target sequences may be susceptible to repeated cleavage by a single gRNA, hence promoting C2c1's application in HDR mediated genome editing (Front Plant Sci. 2016 Nov. 14; 7:1683). In certain embodiments, the locus of interest is modified by the CRISPR-C2c1 complex via homology directed repair (HR or HDR). In certain embodiments, the locus of interest is modified by the CRISPR-C2c1 complex independent of HR. In certain embodiments, the locus of interest is modified by the CRISPR-C2c1 complex via non-homologous end joining (NHEJ).

C2c1 generates a staggered cut with a 5' overhang, in contrast to the blunt ends generated by Cas9 (Garneau et al., Nature. 2010; 468:67-71; Gasiunas et al., Proc Natl Acad Sci USA. 2012; 109:E2579-2586). This structure of the cleavage product could be particularly advantageous for facilitating non-homologous end joining (NHEJ)-based gene insertion into the mammalian genome (Maresca et al., Genome research. 2013; 23:539-546). In some embodiments, the CRISPR-C2c1 system introduces an exogenous DNA insertion at the staggered DSB via HR or NHEJ. In certain embodiments, the locus of interest is modified by the CRISPR-C2c1 complex by inserting, or "knocking-in" a template DNA sequence. In particular embodiments, the DNA insert is designed to integrate into the genome in the proper orientation. In preferred embodiments, the locus of interest is modified by the CRISPR-C2c1 system in non-dividing cells, where genome editing via homology-directed repair (HDR) mechanisms are especially challenging (Chan et al., Nucleic acids research. 2011; 39:5955-5966). Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic L02 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage. See Zhang et al., Genome Biology 201718:35; He et al., Nucleic Acids Research, 44: 9, 2016.

Usher Syndrome or Retinitis Pigmentosa-39

In some embodiments, the treatment, prophylaxis or diagnosis of Usher Syndrome or retinitis pigmentosa-39 is provided. The target is preferably the USH2A gene. In some embodiments, correction of a G deletion at position 2299 (2299delG) is provided. This is described in WO2015134812A1, the disclosure of which is hereby incorporated by reference. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Autoimmune and Inflammatory Disorders

In some embodiments, autoimmune and inflammatory disorders are treated. These include Multiple Sclerosis (MS) or Rheumatoid Arthritis (RA), for example.

Cystic Fibrosis (CF)

In some embodiments, the treatment, prophylaxis or diagnosis of cystic fibrosis is provided. The target is preferably the SCNN1A or the CFTR gene. This is described in WO2015157070, the disclosure of which is hereby incorporated by reference.

Schwank et al. (Cell Stem Cell, 13:653-58, 2013) used CRISPR-Cas9 to correct a defect associated with cystic fibrosis in human stem cells. The team's target was the gene for an ion channel, cystic fibrosis transmembrane conductor receptor (CFTR). A deletion in CFTR causes the protein to misfold in cystic fibrosis patients. Using cultured intestinal stem cells developed from cell samples from two children with cystic fibrosis, Schwank et al. were able to correct the defect using CRISPR along with a donor plasmid containing the reparative sequence to be inserted. The researchers then grew the cells into intestinal "organoids," or miniature guts, and showed that they functioned normally. In this case, about half of clonal organoids underwent the proper genetic correction.

In some embodiments, Cystic fibrosis is treated, for example. Delivery to the lungs is therefore preferred. The F508 mutation (delta-F508, full name CFTRAF508 or F508del-CFTR) is preferably corrected. In some embodiments, the targets may be ABCC7, CF or MRP7.

In another embodiment, the method of Patent Publication US20170022507 assigned to Editas medicine, which is related to Crispr-Cas related methods and compositions for treating cystic fibrosis, may be modified for the CRISPR-Cas system disclosed in the present invention. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Duchenne's Muscular Dystrophy

Duchenne's muscular dystrophy (DMD) is a recessive, sex-linked muscle wasting disease that affects approximately 1 in 5000 males at birth. Mutations of the dystrophin gene result in an absence of dystrophin in skeletal muscle, where it normally functions to connect the cytoskeleton of the muscle fiber to the basal lamina. The absence of dystrophin caused be these mutations results in excessive calcium entry into the soma which causes the mitochondria to rupture, destroying the cell. Current treatments are focused on easing the symptoms of DMD, and the average life expectancy is approximately 26 years.

CRISPR/Cas9 efficacy as a treatment for certain types of DMD has been demonstrated in mouse models. In one such study, the muscular dystrophy phenotype was partially corrected in the mouse by knocking-out a mutant exon resulting in a functional protein (see Nelson et al. (2016) Science, Long et al. (2016) Science, and Tabebordbar et al. (2016) Science).

In some embodiments, the method of Patent Publication WO2016161380 assigned to Editas Medine, which is related to Crispr related method of treating DMD, may be modified for application of the CRISPR-Cas system of this invention. In some embodiments, DMD is treated. In some embodiments, delivery is to the muscle by injection. In some embodiments, the CRISPR protein is a C2c1, and the system comprises: I. a CRISPR-Cas system RNA polynucleotide sequence, wherein the polynucleotide sequence comprises: (a) a tracr RNA polynucleotide and a guide RNA polynucleotide capable of hybridizing to a target sequence, and (b) a direct repeat RNA polynucleotide, and II. a polynucleotide sequence encoding the C2c1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence, and the polynucleotide sequence encoding a CRISPR protein is DNA or RNA.

In some embodiments, the CRISPR-C2c1 system recognizes T-rich PAMs. In particular embodiments, the PAM is 5'-TTN-3' or 5'-ATTN-3'. In certain embodiments, the locus of interest is modified by the CRISPR-C2c1 complex by inserting, or "knocking-in" a template DNA sequence. In particular embodiments, the DNA insert is designed to integrate into the genome in the proper orientation. Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic L02 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage.

Glycogen Storage Diseases, Including 1a

Glycogen Storage Disease 1a is a genetic disease resulting from deficiency of the enzyme glucose-6-phosphatase. The deficiency impairs the ability of the liver to produce free glucose from glycogen and from gluconeogenesis. In some embodiments, the gene encoding the glucose-6-phosphatase enzyme is targeted. In some embodiments, Glycogen Storage Disease 1a is treated. In some embodiments, delivery is to the liver by encapsulation of the C2c1 (in protein or mRNA form) in a lipid particle, such as an LNP. With respect to the C2c1 protein the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

In some embodiments, Glycogen Storage Diseases, including 1a, are targeted and preferably treated, for example by targeting polynucleotides associated with the condition/disease/infection. The associated polynucleotides include DNA, which may include genes (where genes include any coding sequence and regulatory elements such as enhancers or promoters). In some embodiments, the associated polynucleotides may include the SLC2A2, GLUT2, G6PC, G6PT, G6PT1, GAA, LAMP2, LAMPB, AGL, GDE, GBE1, GYS2, PYGL, or PFKM genes.

Hurler Syndrome

Hurler syndrome, also known as mucopolysaccharidosis type I (MPS I), Hurler's disease, is a genetic disorder that results in the buildup of glycosaminoglycans (formerly known as mucopolysaccharides) due to a deficiency of alpha-L iduronidase, an enzyme responsible for the degradation of mucopolysaccharides in lysosomes. Hurler syndrome is often classified as a lysosomal storage disease, and is clinically related to Hunter Syndrome. Hunter syndrome is X-linked while Hurler syndrome is autosomal recessive. MPS I is divided into three subtypes based on severity of symptoms. All three types result from an absence of, or insufficient levels of, the enzyme α-L-iduronidase. MPS I H or Hurler syndrome is the most severe of the MPS I subtypes. The other two types are MPS I S or Scheie syndrome and MPS I H-S or Hurler-Scheie syndrome. Children born to an MPS I parent carry a defective IDUA gene, which has been mapped to the 4p16.3 site on chromosome 4. The gene is named IDUA because of its iduronidase enzyme protein product. As of 2001, 52 different mutations in the IDUA gene have been shown to cause Hurler syndrome. Successful treatment of the mouse, dog, and cat models of MPS I by delivery of the iduronidase gene through retroviral, lentiviral, AAV, and even nonviral vectors.

In some embodiments, the α-L-iduronidase gene is targeted and a repair template preferably provided. In some embodiments, the CRISPR protein is a C2c1, and the system comprises: I. a CRISPR-Cas system RNA polynucleotide sequence, wherein the polynucleotide sequence comprises: (a) a guide RNA polynucleotide capable of hybridizing to a target sequence, and (b) a direct repeat RNA polynucleotide, and II. a polynucleotide sequence encoding the C2c1, optionally comprising at least one or more nuclear localization sequences, wherein the direct repeat sequence hybridizes to the guide sequence and directs sequence-specific binding of a CRISPR complex to the target sequence, and wherein the CRISPR complex comprises the CRISPR protein complexed with (1) the guide sequence that is hybridized or hybridizable to the target sequence, and (2) the direct repeat sequence, and the polynucleotide sequence encoding a CRISPR protein is DNA or RNA. In certain embodiments, the C2c1 effector protein recognizes T-rich PAMs. In particular embodiments, the PAM is 5'-TTN-3' or 5'-ATTN-3'. In certain embodiments, the locus of interest related to MPS I is modified by the CRISPR-C2c1 complex by creating staggered cuts with 5' overhangs. In some embodiments, the 5' overhang is 7 nt. In some embodiments, the staggered cuts are followed by NHEJ or HDR. In certain embodiments, the locus of interest is modified by the CRISPR-C2c1 complex by inserting, or "knocking-in" a template DNA sequence. In particular embodiments, the DNA insert is designed to integrate into the genome in the proper orientation. Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic L02 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage.

HIV and AIDS

In some embodiments, the treatment, prophylaxis or diagnosis of HIV and AIDS is provided. The target is preferably the CCR5 gene in HIV. This is described in WO2015148670A1, the disclosure of which is hereby incorporated by reference. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Beta Thalassaemia and Sickle Cell Disease (SCD)

In some embodiments, the treatment, prophylaxis or diagnosis of Beta Thalassaemia is provided. The target is preferably the BCL11A gene. This is described in WO2015148860, the disclosure of which is hereby incorporated by reference. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

In some embodiments, the treatment, prophylaxis or diagnosis of Sickle Cell Disease (SCD) is provided. The target is preferably the HBB or BCL11A gene. This is described in WO2015148863, the disclosure of which is hereby incorporated by reference. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene. In certain embodiments, the locus of interest is modified by the CRISPR-C2c1 complex by inserting, or “knocking-in” a template DNA sequence. In particular embodiments, the DNA insert is designed to integrate into the genome in the proper orientation. In preferred embodiments, the locus of interest is modified by the CRISPR-C2c1 system in non-dividing cells, where genome editing via homology-directed repair (HDR) mechanisms are especially challenging (Chan et al., Nucleic acids research. 2011; 39:5955-5966). Maresca et al. (Genome Res. 2013 March; 23(3): 539-546) described a method of site directed, precise insertion applicable with zinc finger nucleases (ZFNs) and Tale nucleases (TALENs) wherein short, double-stranded DNAs with 5' overhangs were ligated to complementary ends, which allowed precise insertion of 15-kb exogeneous expression cassette at defined locus in human cell lines. He et al. (Nucleic Acids Res. 2016 May 19; 44(9)) described CRISPR/Cas9-induced site-specific knock-in of a 4.6 kb promoterless ires-eGFP fragment into the GAPDH locus yielded up to 20% GFP+ cells in somatic L02 cells, and 1.70% GFP+ cells in human embryonic stem cells mediated by the NHEJ pathway and also reported that the NHEJ-based knock-in is more efficient than HDR-mediated gene targeting in all human cell types examined. Because C2c1 generates a staggered cut with a 5' overhang, one with ordinary skill in the art could use the methods similar to that as described in Meresca et al. and He et al. to generate exogenous DNA insertions at a locus of interest with the CRISPR-C2c1 system disclosed herein.

In certain embodiments, the locus of interest is first modified by the CRISPR-C2c1 system at the distal end of the PAM sequence, and further modified by the CRISPR-C2c1 system near the PAM sequence and repaired via HDR. In certain embodiments, the locus of interest is modified by the CRISPR-C2c1 system by introducing a mutation, deletion, or insertion of exogenous DNA sequence via HDR. In some embodiments, the locus of interest is modified by the CRISPR-C2c1 system by introducing a mutation, deletion, or insertion of exogenous DNA sequence via NHEJ. In preferred embodiments, the exogenous DNA is flanked by single guide DNA (sgDNA)-PAM sequences on both 3' and 5' ends. In preferred embodiments, the exogenous DNA is released after CRISPR-C2c1 cleavage.

Herpes Simplex Virus 1 and 2

Herpesviridae are a family of viruses composed of linear double-stranded DNA genomes with 75-200 genes. For the purposes of gene editing, the most commonly studied family member is Herpes Simplex Virus-1 (HSV-1), a virus which has a distinct number of advantages over other viral vectors (reviewed in Vannuci et al. (2003)). Thus, in some embodiments, the viral vector is an HSV viral vector. In some embodiments, the HSV viral vector is HSV-1.

HSV-1 has a large genome of approximately 152 kb of double stranded DNA. This genome comprises of more than 80 genes, many of which can be replaced or removed, allowing a gene insert of between 30-150 kb. The viral vectors derived from HSV-1 are generally separated into 3 groups: replication-competent attenuated vectors, replication-incompetent recombinant vectors, and defective helper-dependent vectors known as amplicons. Gene transfer using HSV-1 as a vector has been demonstrated previously, for instance for the treatment of neuropathic pain (see, e.g., Wolfe et al. (2009) Gene Ther) and rheumatoid arthritis (see e.g., Burton et al. (2001) Stem Cells).

Thus, in some embodiments, the viral vector is an HSV viral vector. In some embodiments, the HSV viral vector is HSV-1. In some embodiments, the vector is used for delivery of one or more CRISPR components. It may be particularly useful for delivery of the C2c1 and one or more guide RNAs, for example 2 or more, 3 or more, or 4 or more guide RNAs. In some embodiments, the vector is theretofore useful in a multiplex system. In some embodiments, this delivery is for the treatment of treatment of neuropathic pain or rheumatoid arthritis.

In some embodiments, the treatment, prophylaxis or diagnosis of HSV-1 (Herpes Simplex Virus 1) is provided. The target is preferably the UL19, UL30, UL48 or UL50 gene in HSV-1. This is described in WO2015153789, the disclosure of which is hereby incorporated by reference.

In other embodiments, the treatment, prophylaxis or diagnosis of HSV-2 (Herpes Simplex Virus 2) is provided. The target is preferably the UL19, UL30, UL48 or UL50 gene in HSV-2. This is described in WO2015153791, the disclosure of which is hereby incorporated by reference.

In some embodiments, the treatment, prophylaxis or diagnosis of Primary Open Angle Glaucoma (POAG) is provided. The target is preferably the MYOC gene. This is described in WO2015153780, the disclosure of which is hereby incorporated by reference. The present invention may be applied with the methods as described above. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

Adoptive Cell Therapies

The present invention also contemplates use of the CRISPR-Cas system described herein, e.g., C2c1 effector protein systems, to modify cells for adoptive therapies.

As used herein, “ACT”, “adoptive cell therapy” and “adoptive cell transfer” may be used interchangeably. In certain embodiments, Adoptive cell therapy (ACT) can refer to the transfer of cells to a patient with the goal of transferring the functionality and characteristics into the new host by engraftment of the cells (see, e.g., Mettananda et al., Editing an α-globin enhancer in primary human hematopoietic stem cells as a treatment for β-thalassemia, Nat Commun. 2017 Sep. 4; 8(1):424). As used herein, the term “engraft” or “engraftment” refers to the process of cell incorporation into a tissue of interest in vivo through contact with existing cells of the tissue. Adoptive cell therapy (ACT) can refer to the transfer of cells, most commonly immune-derived cells, back into the same patient or into a new recipient host with the goal of transferring the immunologic functionality and characteristics into the new host. If possible, use of autologous cells helps the recipient by minimizing GVHD issues. The adoptive transfer of autologous tumor infiltrating lymphocytes (TIL) (Besser et al., (2010) Clin. Cancer Res 16 (9) 2646-55; Dudley et al., (2002) Science 298 (5594): 850-4; and Dudley et al., (2005) Journal of Clinical Oncology 23 (10): 2346-57.) or genetically re-directed peripheral blood mononuclear cells (Johnson et al., (2009) Blood 114 (3): 535-46; and Morgan et al., (2006) Science 314(5796) 126-9) has been used to successfully treat patients with advanced solid tumors, including melanoma and colorectal carcinoma, as well as patients with CD19-expressing hematologic malignancies (Kalos et al., (2011) Science Translational Medicine 3 (95): 95ra73). In certain embodiments, allogenic cells immune cells are transferred (see, e.g., Ren et al., (2017) Clin Cancer Res 23 (9) 2255-2266). As described further herein, allogenic cells can be edited to reduce alloreactivity and prevent graft-versus-host disease. Thus, use of allogenic cells allows for cells to be obtained from healthy donors and prepared for use in patients as opposed to preparing autologous cells from a patient after diagnosis.

In some embodiments, the invention described herein relates to a method for adoptive immunotherapy, in which T cells are edited ex vivo by CRISPR to modulate at least one gene and subsequently administered to a patient in need thereof. In some embodiments, the CRISPR editing comprising knocking-out or knocking-down the expression of at least one target gene in the edited T cells. In some embodiments, in addition to modulating the target gene, the T cells are also edited ex vivo by CRISPR to (1) knock-in an exogenous gene encoding a chimeric antigen receptor (CAR) or a T-cell receptor (TCR), (2) knock-out or knock-down expression of an immune checkpoint receptor, (3) knock-out or knock-down expression of an endogenous TCR, (4) knock-out or knock-down expression of a human leukocyte antigen class I (HLA-I) proteins, and/or (5) knock-out or knock-down expression of an endogenous gene encoding an antigen targeted by an exogenous CAR or TCR.

In some embodiments, the T cells are contacted ex vivo with an adeno-associated virus (AAV) vector encoding a CRISPR effector protein, and a guide molecule comprising a guide sequence hybridizable to a target sequence, a tracr mate sequence, and a tracr sequence hybridizable to the tracr mate sequence. In some embodiments, the T cells are contacted ex vivo (e.g., by electroporation) with a ribonucleoprotein (RNP) comprising a CRISPR effector protein complexed with a guide molecule, wherein the guide molecule comprising a guide sequence hybridizable to a target sequence, a tracr mate sequence, and a tracr sequence hybridizable to the tracr mate sequence. See Rupp et al., Scientific Reports 7:737 (2017); Liu et al., Cell Research 27:154-157 (2017). In some embodiments, the T cells are contacted ex vivo (e.g., by electroporation) with an mRNA encoding a CRISPR effector protein, and a guide molecule comprising a guide sequence hybridizable to a target sequence, a tracr mate sequence, and a tracr sequence hybridizable to the tracr mate sequence. See Eyquem et al., Nature 543:113-117 (2017). In some embodiments, the T cells are not contacted ex vivo with a lentivirus or retrovirus vector.

In some embodiments, the method comprises editing T cells ex vivo by CRISPR to knock-in an exogenous gene encoding a CAR, thereby allowing the edited T cells to recognize cancer cells based on the expression of specific proteins located on the cell surface. In some embodiments, T cells are edited ex vivo by CRISPR to knock-in an exogenous gene encoding a TCR, thereby allowing the edited T cells to recognize proteins derived from either the surface or inside of the cancer cells. In some embodiments, the method comprising providing an exogenous CAR-encoding or TCR-encoding sequence as a donor sequence, which can be integrated by homology-directed repair (HDR) into a genomic locus targeted by a CRISPR guide sequence. In some embodiments, targeting the exogenous CAR or TCR to an endogenous TCR a constant (TRAC) locus can reduce tonic CAR signaling and facilitate effective internalization and re-expression of the CAR following single or repeated exposure to antigen, thereby delaying effector T-cell differentiation and exhaustion. See Eyquem et al., Nature 543:113-117 (2017).

In some embodiments, the method comprises editing T cells ex vivo by CRISPR to block one or more immune checkpoint receptors to reduce immunosuppression by cancer cells. In some embodiments, T cells are edited ex vivo by CRISPR to knock-out or knock-down an endogenous gene involved in the programmed death-1 (PD-1) signaling pathway, such as PD-1 and PD-L1. In some embodiments, T cells are edited ex vivo by CRISPR to mutate the Pdcd1 locus or the CD274 locus. In some embodiments, T cells are edited ex vivo by CRISPR using one or more guide sequences targeting the first exon of PD-1. See Rupp et al., Scientific Reports 7:737 (2017); Liu et al., Cell Research 27:154-157 (2017).

In some embodiments, the method comprises editing T cells ex vivo by CRISPR to eliminate potential alloreactive TCRs to allow allogeneic adoptive transfer. In some embodiments, T cells are edited ex vivo by CRISPR to knock-out or knock-down an endogenous gene encoding a TCR (e.g., an ap TCR) to avoid graft-versus-host-disease (GVHD). In some embodiments, T cells are edited ex vivo by CRISPR to mutate the TRAC locus. In some embodiments, T cells are edited ex vivo by CRISPR using one or more guide sequences targeting the first exon of TRAC. See Liu et al., Cell Research 27:154-157 (2017). In some embodiments, the method comprises use of CRISPR to knock-in an exogenous gene encoding a CAR or a TCR into the TRAC locus, while simultaneously knocking-out the endogenous TCR (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous TCR promoter.

In some embodiments, the method comprises editing T cells ex vivo by CRISPR to knock-out or knock-down an endogenous gene encoding an HLA-I protein to minimize immunogenicity of the edited T cells. In some embodiments, T cells are edited ex vivo by CRISPR to mutate the beta-2 microglobulin (B2M) locus. In some embodiments, T cells are edited ex vivo by CRISPR using one or more guide sequences targeting the first exon of B2M. See Liu et al., Cell Research 27:154-157 (2017). In some embodiments, the method comprises use of CRISPR to knock-in an exogenous gene encoding a CAR or a TCR into the B2M locus, while simultaneously knocking-out the endogenous B2M (e.g., with a donor sequence encoding a self-cleaving P2A peptide following the CAR cDNA). See Eyquem et al., Nature 543:113-117 (2017). In some embodiments, the exogenous gene comprises a promoter-less CAR-encoding or TCR-encoding sequence which is inserted operably downstream of an endogenous B2M promoter.

In some embodiments, the method comprises editing T cells ex vivo by CRISPR to knock-out or knock-down an endogenous gene encoding an antigen targeted by an exogenous CAR or TCR. In some embodiments, the T cells are edited ex vivo by CRISPR to knock-out or knock-down the expression of a tumor antigen selected from human telomerase reverse transcriptase (hTERT), survivin, mouse double minute 2 homolog (MDM2), cytochrome P450 1B 1 (CYP1B), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53 or cyclin (DI) (see WO2016/011210). In some embodiments, the T cells are edited ex vivo by CRISPR to knock-out or knock-down the expression of an antigen selected from B cell maturation antigen (BCMA), transmembrane activator and CAML Interactor (TACI), or B-cell activating factor receptor (BAFF-R), CD38, CD138, CS-1, CD33, CD26, CD30, CD53, CD92, CD100, CD148, CD150, CD200, CD261, CD262, or CD362 (see WO2017/011804).

Aspects of the invention accordingly involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144). Various strategies may for example be employed to genetically modify T cells by altering the specificity of the T cell receptor (TCR) for example by introducing new TCR a and R chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Autologous T cells engineered to express chimeric antigen receptors (CARs) against leukemia antigens such as CD19 on B cells have shown promising results for the treatment of relapsed or refractory B-cell malignancies. However, a subset of cancer patients especially heavily pretreated cancer patients could be unable to receive this highly active therapy because of failed expansion. Moreover, it is still a challenge to manufacture an effective therapeutic product for infant cancer patients due to their small blood volume. On the other hand, the inherent characters of autologous CAR-T cell therapy including personalized autologous T cell manufacturing and widely "distributed" approach result in the difficulty of industrialization of autologous CAR-T cell therapy. Universal CD19-specific CAR-T cell (UCART019) derived from one or more healthy unrelated donors could avoid graft-versus-host-disease (GVHD) and minimize their immunogenicity, is undoubtedly an alternative option to address above-mentioned issues. Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI 1a-CD18, CD2, ICOS, CD27, CD154, CDS, OX40, 4-1BB, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native αβTCR, for example by antigen on professional antigen-presenting cells, with attendant costimulation. In addition, additional engineered receptors may be provided on the immunoresponsive cells, for example to improve targeting of a T-cell attack and/or minimize side effects. Han et. al (clinicaltrials, A Study Evaluating UCART019 in Patients with Relapsed or Refractory CD19+ Lukemia and Lymphoma) have generated gene-disrupted allogeneic CD19-directed BBζ CAR-T cells (termed UCART019) by combining the lentiviral delivery of CAR and CRISPR RNA electroporation to disrupt endogenous TCR and B2M genes simultaneously and will test whether it can evade host-mediated immunity and deliver antileukemic effects without GVHD.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3ζ and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to treat tumor xenografts.

In general, CARs are comprised of an extracellular domain, a transmembrane domain, and an intracellular domain, wherein the extracellular domain comprises an antigen-binding domain that is specific for a predetermined target. While the antigen-binding domain of a CAR is often an antibody or antibody fragment (e.g., a single chain variable fragment, scFv), the binding domain is not particularly limited so long as it results in specific recognition of a target. For example, in some embodiments, the antigen-binding domain may comprise a receptor, such that the CAR is capable of binding to the ligand of the receptor. Alternatively, the antigen-binding domain may comprise a ligand, such that the CAR is capable of binding the endogenous receptor of that ligand.

The antigen-binding domain of a CAR is generally separated from the transmembrane domain by a hinge or spacer. The spacer is also not particularly limited, and it is designed to provide the CAR with flexibility. For example, a spacer domain may comprise a portion of a human Fc domain, including a portion of the CH3 domain, or the hinge region of any immunoglobulin, such as IgA, IgD, IgE, IgG, or IgM, or variants thereof. Furthermore, the hinge region may be modified so as to prevent off-target binding by FcRs or other potential interfering objects. For example, the hinge may comprise an IgG4 Fc domain with or without a S228P, L235E, and/or N297Q mutation (according to Kabat numbering) in order to decrease binding to FcRs. Additional spacers/hinges include, but are not limited to, CD4, CD8, and CD28 hinge regions.

The transmembrane domain of a CAR may be derived either from a natural or from a synthetic source. Where the source is natural, the domain may be derived from any membrane bound or transmembrane protein. Transmembrane regions of particular use in this disclosure may be derived from CD8, CD28, CD3, CD45, CD4, CD5, CDS, CD9, CD 16, CD22, CD33, CD37, CD64, CD80, CD86, CD 134, CD137, CD 154, TCR. Alternatively, the transmembrane domain may be synthetic, in which case it will comprise predominantly hydrophobic residues such as leucine and valine. Preferably a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker.

Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI 1a-CD18, CD2, ICOS, CD27, CD154, CDS, OX40, 4-1BB, CD2, CD7, LIGHT, LFA-1, NKG2C, B7-H3, CD30, CD40, PD-1, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). In certain embodiments, the primary signaling domain comprises a functional signaling domain of a protein selected from the group consisting of CD3 zeta, CD3 gamma, CD3 delta, CD3 epsilon, common FcR gamma (FCERIG), FcR beta (Fc Epsilon Rib), CD79a, CD79b, Fc gamma RIIa, DAP10, and DAP12. In certain preferred embodiments, the primary signaling domain comprises a functional signaling domain of CD3ζ or FcRγ. In certain embodiments, the one or more costimulatory signaling domains comprise a functional signaling domain of a protein selected, each independently, from the group consisting of: CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8 alpha, CD8 beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Lyl08), SLAM (SLAMF1, CD150, IPO-3), BLAME (SLAMF8), SELPLG (CD162), LTBR, LAT, GADS, SLP-76, PAG/Cbp, NKp44, NKp30, NKp46, and NKG2D. In certain embodiments, the one or more costimulatory signaling domains comprise a functional signaling domain of a protein selected, each independently, from the group consisting of: 4-1BB, CD27, and CD28. In certain embodiments, a chimeric antigen receptor may have the design as described in U.S. Pat. No. 7,446,190, comprising an intracellular domain of CD3ζ chain (such as amino acid residues 52-163 of the human CD3 zeta chain, as shown in SEQ ID NO: 14 of U.S. Pat. No. 7,446,190), a signaling region from CD28 and an antigen-binding element (or portion or domain; such as scFv). The CD28 portion, when between the zeta chain portion and the antigen-binding element, may suitably include the transmembrane and signaling domains of CD28 (such as amino acid residues 114-220 of SEQ ID NO: 10, full sequence shown in SEQ ID NO: 6 of U.S. Pat. No. 7,446,190; these can include the following portion of CD28 as set forth in Genbank identifier NM_006139 (sequence version 1, 2 or 3):

```
                                         (SEQ ID NO: 478)
IEVMYPPPYLDNEKSNGTIIHVKGKHLCPSPLFPGPSKPFWVLVVVGGVL

ACYSLLVTVAFIIFWVRSKRSRLLHSDYMNMTPRRPGPTRKHYQPYAPPR

DFAAYRS).
```

Alternatively, when the zeta sequence lies between the CD28 sequence and the antigen-binding element, intracellular domain of CD28 can be used alone (such as amino sequence set forth in SEQ ID NO: 9 of U.S. Pat. No.

7,446,190). Hence, certain embodiments employ a CAR comprising (a) a zeta chain portion comprising the intracellular domain of human CD3ζ chain, (b) a costimulatory signaling region, and (c) an antigen-binding element (or portion or domain), wherein the costimulatory signaling region comprises the amino acid sequence encoded by SEQ ID NO: 6 of U.S. Pat. No. 7,446,190.

Alternatively, costimulation may be orchestrated by expressing CARs in antigen-specific T cells, chosen so as to be activated and expanded following engagement of their native αβTCR, for example by antigen on professional antigen-presenting cells, with attendant costimulation. In addition, additional engineered receptors may be provided on the immunoresponsive cells, for example to improve targeting of a T-cell attack and/or minimize side effects.

By means of an example and without limitation, Kochenderfer et al., (2009) J Immunother. 32 (7): 689-702 described anti-CD19 chimeric antigen receptors (CAR). FMC63-28Z CAR contained a single chain variable region moiety (scFv) recognizing CD19 derived from the FMC63 mouse hybridoma (described in Nicholson et al., (1997) Molecular Immunology 34: 1157-1165), a portion of the human CD28 molecule, and the intracellular component of the human TCR-ζ molecule. FMC63-CD828BBZ CAR contained the FMC63 scFv, the hinge and transmembrane regions of the CD8 molecule, the cytoplasmic portions of CD28 and 4-1BB, and the cytoplasmic component of the TCR-ζ molecule. The exact sequence of the CD28 molecule included in the FMC63-28Z CAR corresponded to Genbank identifier NM_006139; the sequence included all amino acids starting with the amino acid sequence IEVMYPPPY and continuing all the way to the carboxy-terminus of the protein. To encode the anti-CD19 scFv component of the vector, the authors designed a DNA sequence which was based on a portion of a previously published CAR (Cooper et al., (2003) Blood 101: 1637-1644). This sequence encoded the following components in frame from the 5' end to the 3' end: an XhoI site, the human granulocyte-macrophage colony-stimulating factor (GM-CSF) receptor α-chain signal sequence, the FMC63 light chain variable region (as in Nicholson et al., supra), a linker peptide (as in Cooper et al., supra), the FMC63 heavy chain variable region (as in Nicholson et al., supra), and a NotI site. A plasmid encoding this sequence was digested with XhoI and NotI. To form the MSGV-FMC63-28Z retroviral vector, the XhoI and NotI-digested fragment encoding the FMC63 scFv was ligated into a second XhoI and NotI-digested fragment that encoded the MSGV retroviral backbone (as in Hughes et al., (2005) Human Gene Therapy 16: 457-472) as well as part of the extracellular portion of human CD28, the entire transmembrane and cytoplasmic portion of human CD28, and the cytoplasmic portion of the human TCR-ζ molecule (as in Maher et al., 2002) Nature Biotechnology 20: 70-75). The FMC63-28Z CAR is included in the KTE-C19 (axicabtagene ciloleucel) anti-CD19 CAR-T therapy product in development by Kite Pharma, Inc. for the treatment of inter alia patients with relapsed/refractory aggressive B-cell non-Hodgkin lymphoma (NHL). Accordingly, in certain embodiments, cells intended for adoptive cell therapies, more particularly immunoresponsive cells such as T cells, may express the FMC63-28Z CAR as described by Kochenderfer et al. (supra). Hence, in certain embodiments, cells intended for adoptive cell therapies, more particularly immunoresponsive cells such as T cells, may comprise a CAR comprising an extracellular antigen-binding element (or portion or domain; such as scFv) that specifically binds to an antigen, an intracellular signaling domain comprising an intracellular domain of a CD3ζ chain, and a costimulatory signaling region comprising a signaling domain of CD28. Preferably, the CD28 amino acid sequence is as set forth in Genbank identifier NM_006139 (sequence version 1, 2 or 3) starting with the amino acid sequence IEVMYPPPY and continuing all the way to the carboxy-terminus of the protein. The sequence is reproduced herein:

```
                                    (SEQ ID NO: 479)
IEVMYPPPYLDNEKSNGTIIHVKGKHLCPSPLFPGPSKPFWVLVVVGGVL

ACYSLLVTVAFIIFWVRSKRSRLLHSDYMNMTPRRPGPTRKHYQPYAPPR

DFAAYRS.
```

Preferably, the antigen is CD19, more preferably the antigen-binding element is an anti-CD19 scFv, even more preferably the anti-CD19 scFv as described by Kochenderfer et al. (supra).

Additional anti-CD19 CARs are further described in WO2015187528. More particularly Example 1 and Table 1 of WO2015187528, incorporated by reference herein, demonstrate the generation of anti-CD19 CARs based on a fully human anti-CD19 monoclonal antibody (47G4, as described in US20100104509) and murine anti-CD19 monoclonal antibody (as described in Nicholson et al. and explained above). Various combinations of a signal sequence (human CD8-alpha or GM-CSF receptor), extracellular and transmembrane regions (human CD8-alpha) and intracellular T-cell signaling domains (CD28-CD3ζ; 4-1BB-CD3ζ; CD27-CD3ζ; CD28-CD27-CD3ζ, 4-1BB-CD27-CD3ζ; CD27-4-1BB-CD3ζ; CD28-CD27-FcεRI gamma chain; or CD28-FcεRI gamma chain) were disclosed. Hence, in certain embodiments, cells intended for adoptive cell therapies, more particularly immunoresponsive cells such as T cells, may comprise a CAR comprising an extracellular antigen-binding element that specifically binds to an antigen, an extracellular and transmembrane region as set forth in Table 1 of WO2015187528 and an intracellular T-cell signaling domain as set forth in Table 1 of WO2015187528. Preferably, the antigen is CD19, more preferably the antigen-binding element is an anti-CD19 scFv, even more preferably the mouse or human anti-CD19 scFv as described in Example 1 of WO2015187528. In certain embodiments, the CAR comprises, consists essentially of or consists of an amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, or SEQ ID NO: 13 as set forth in Table 1 of WO2015187528.

By means of an example and without limitation, chimeric antigen receptor that recognizes the CD70 antigen is described in WO2012058460A2 (see also, Park et al., CD70 as a target for chimeric antigen receptor T cells in head and neck squamous cell carcinoma, Oral Oncol. 2018 March; 78:145-150; and Jin et al., CD70, a novel target of CAR T-cell therapy for gliomas, Neuro Oncol. 2018 Jan. 10; 20(1):55-65). CD70 is expressed by diffuse large B-cell and follicular lymphoma and also by the malignant cells of Hodgkins lymphoma, Waldenstrom's macroglobulinemia and multiple myeloma, and by HTLV-1- and EBV-associated malignancies. (Agathanggelou et al. Am. J. Pathol. 1995; 147: 1152-1160; Hunter et al., Blood 2004; 104:4881. 26; Lens et al., J Immunol. 2005; 174:6212-6219; Baba et al., J Virol. 2008; 82:3843-3852.) In addition, CD70 is expressed by non-hematological malignancies such as renal cell carcinoma and glioblastoma. (Junker et al., J Urol. 2005;

173:2150-2153; Chahlavi et al., Cancer Res 2005; 65:5428-5438). Physiologically, CD70 expression is transient and restricted to a subset of highly activated T, B, and dendritic cells.

By means of an example and without limitation, chimeric antigen receptor that recognizes BCMA has been described (see, e.g., US20160046724A1; WO2016014789A2; WO2017211900A1; WO2015158671A1; US20180085444A1; WO2018028647A1; US20170283504A1; and WO2013154760A1).

The CRISPR systems disclosed herein may be used for targeting an antigen to be targeted in adoptive cell therapy. In certain embodiments, an antigen (such as a tumor antigen) to be targeted in adoptive cell therapy (such as TIL, CAR, or TCR T-cell therapy) of a disease (such as particularly of tumor or cancer) may be selected from a group consisting of: B cell maturation antigen (BCMA) (see, e.g., Friedman et al., Effective Targeting of Multiple BCMA-Expressing Hematological Malignancies by Anti-BCMA CAR T Cells, Hum Gene Ther. 2018 Mar. 8; Berdeja J G, et al. Durable clinical responses in heavily pretreated patients with relapsed/refractory multiple myeloma: updated results from a multicenter study of bb2121 anti-Bcma CAR T cell therapy. Blood. 2017; 130:740; and Mouhieddine and Ghobrial, Immunotherapy in Multiple Myeloma: The Era of CAR T Cell Therapy, Hematologist, May-June 2018, Volume 15, issue 3); PSA (prostate-specific antigen); prostate-specific membrane antigen (PSMA); PSCA (Prostate stem cell antigen); Tyrosine-protein kinase transmembrane receptor ROR1; fibroblast activation protein (FAP); Tumor-associated glycoprotein 72 (TAG72); Carcinoembryonic antigen (CEA); Epithelial cell adhesion molecule (EPCAM); Mesothelin; Human Epidermal growth factor Receptor 2 (ERBB2 (Her2/neu)); Prostase; Prostatic acid phosphatase (PAP); elongation factor 2 mutant (ELF2M); Insulin-like growth factor 1 receptor (IGF-1R); gplOO; BCR-ABL (breakpoint cluster region-Abelson); tyrosinase; New York esophageal squamous cell carcinoma 1 (NY-ESO-1); K-light chain, LAGE (L antigen); MAGE (melanoma antigen); Melanoma-associated antigen 1 (MAGE-A1); MAGE A3; MAGE A6; legumain; Human papillomavirus (HPV) E6; HPV E7; prostein; survivin; PCTA1 (Galectin 8); Melan-A/MART-1; Ras mutant; TRP-1 (tyrosinase related protein 1, or gp75); Tyrosinase-related Protein 2 (TRP2); TRP-2/INT2 (TRP-2/intron 2); RAGE (renal antigen); receptor for advanced glycation end products 1 (RAGE1); Renal ubiquitous 1, 2 (RU1, RU2); intestinal carboxyl esterase (iCE); Heat shock protein 70-2 (HSP70-2) mutant; thyroid stimulating hormone receptor (TSHR); CD123; CD171; CD19; CD20; CD22; CD26; CD30; CD33; CD44v7/8 (cluster of differentiation 44, exons 7/8); CD53; CD92; CD100; CD148; CD150; CD200; CD261; CD262; CD362; CS-1 (CD2 subset 1, CRACC, SLAMF7, CD319, and 19A24); C-type lectin-like molecule-1 (CLL-1); ganglioside GD3 (aNeu5Ac (2-8)aNeu5Ac(2-3)bDGalp(1-4)bDGlcp(1-1)Cer); Tn antigen (Tn Ag); Fms-Like Tyrosine Kinase 3 (FLT3); CD38; CD138; CD44v6; B7H3 (CD276); KIT (CD117); Interleukin-13 receptor subunit alpha-2 (IL-13Ra2); Interleukin 11 receptor alpha (IL-11Ra); prostate stem cell antigen (PSCA); Protease Serine 21 (PRSS21); vascular endothelial growth factor receptor 2 (VEGFR2); Lewis(Y) antigen; CD24; Platelet-derived growth factor receptor beta (PDGFR-beta); stage-specific embryonic antigen-4 (SSEA-4); Mucin 1, cell surface associated (MUC1); mucin 16 (MUC16); epidermal growth factor receptor (EGFR); epidermal growth factor receptor variant III (EGFRvIII); neural cell adhesion molecule (NCAM); carbonic anhydrase IX (CAIX); Proteasome (Prosome, Macropain) Subunit, Beta Type, 9 (LMP2); ephrin type-A receptor 2 (EphA2); Ephrin B2; Fucosyl GM1; sialyl Lewis adhesion molecule (sLe); ganglioside GM3 (aNeu5Ac(2-3)bDGalp(1-4)bDGlcp(1-1) Cer); TGS5; high molecular weight-melanoma-associated antigen (HMWMAA); o-acetyl-GD2 ganglioside (OAcGD2); Folate receptor alpha; Folate receptor beta; tumor endothelial marker 1 (TEM1/CD248); tumor endothelial marker 7-related (TEM7R); claudin 6 (CLDN6); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); CT (cancer/testis (antigen)); melanoma cancer testis antigen-1 (MAD-CT-1); melanoma cancer testis antigen-2 (MAD-CT-2); Fos-related antigen 1; p53; p53 mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyltransferase V (NA17); paired box protein Pax-3 (PAX3); Androgen receptor; Cyclin B1; Cyclin D1; v-myc avian myelocytomatosis viral oncogene neuroblastoma derived homolog (MYCN); Ras Homolog Family Member C (RhoC); Cytochrome P450 1B1 (CYP1B1); CCCTC-Binding Factor (Zinc Finger Protein)-Like (BORIS); Squamous Cell Carcinoma Antigen Recognized By T Cells-1 or 3 (SART1, SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint-1, -2, -3 or -4 (SSX1, SSX2, SSX3, SSX4); CD79a; CD79b; CD72; Leukocyte-associated immunoglobulin-like receptor 1 (LAIR1); Fc fragment of IgA receptor (FCAR); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); mouse double minute 2 homolog (MDM2); livin; alphafetoprotein (AFP); transmembrane activator and CAML Interactor (TACI); B-cell activating factor receptor (BAFF-R); V-Ki-ras2 Kirsten rat sarcoma viral oncogene homolog (KRAS); immunoglobulin lambda-like polypeptide 1 (IGLL1); 707-AP (707 alanine proline); ART-4 (adenocarcinoma antigen recognized by T4 cells); BAGE (B antigen; b-catenin/m, b-catenin/mutated); CAMEL (CTL-recognized antigen on melanoma); CAP1 (carcinoembryonic antigen peptide 1); CASP-8 (caspase-8); CDC27m (cell-division cycle 27 mutated); CDK4/m (cycline-dependent kinase 4 mutated); Cyp-B (cyclophilin B); DAM (differentiation antigen melanoma); EGP-2 (epithelial glycoprotein 2); EGP-40 (epithelial glycoprotein 40); Erbb2, 3, 4 (erythroblastic leukemia viral oncogene homolog-2, -3, 4); FBP (folate binding protein); fAchR (Fetal acetylcholine receptor); G250 (glycoprotein 250); GAGE (G antigen); GnT-V (N-acetylglucosaminyltransferase V); HAGE (helicose antigen); ULA-A (human leukocyte antigen-A); HST2 (human signet ring tumor 2); KIAA0205; KDR (kinase insert domain receptor); LDLR/FUT (low density lipid receptor/GDP L-fucose: b-D-galactosidase 2-a-L fucosyltransferase); L1CAM (L1 cell adhesion molecule); MC1R (melanocortin 1 receptor); Myosin/m (myosin mutated); MUM-1, -2, -3 (melanoma ubiquitous mutated 1, 2, 3); NA88-A (NA cDNA clone of patient M88); KG2D (Natural killer group 2, member D) ligands; oncofetal antigen (h5T4); p190 minor bcr-abl (protein of 190 KD bcr-abl); Pml/RARa (promyelocytic leukaemia/retinoic acid receptor a); PRAME (preferentially expressed antigen of melanoma); SAGE (sarcoma antigen); TEL/AML1 (translocation Ets-family leukemia/acute myeloid leukemia 1); TPI/m (triose-phosphate isomerase mutated); CD70; trophoblast glycoprotein (TPBG); avP6 integrin, B7-H3; B7-H6; CD20; CD44; chondroitin sulfate proteoglycan 4 (CSPG4), bDGalpNAc (1-4)[aNeu5Ac(2-8)aNeu5Ac(2-3)]bDGalp(1-4)bDGlcp(1-1)Cer (GD2), aNeu5Ac(2-8)aNeu5Ac(2-3)bDGalp(1-4) bDGlcp(1-1)Cer (GD3); human leukocyte antigen A1 MAGE family member A1 (HLA-A1$^+$MAGEA1); human leukocyte antigen A2 MAGE family member A1 (HLA-A2$^+$ MAGEA1); human leukocyte antigen A3 MAGE family member A1 (HLA-A3$^+$MAGEA1); MAGEA1; human leukocyte antigen A1 New York Esophageal Squamous Cell Carcinoma 1 (FILA-A1$^+$NY-ESO-1); human leukocyte antigen A2 New York Esophageal Squamous Cell Carcinoma 1 (HLA-A2+NY-ESO-1), lambda light chain, kappa light chain, tumor endothelial marker 5 (TEM5), tumor endothelial marker 7 (TEM7), tumor endothelial marker 8 (TEM8), TEM5, TEM7, TEM8, IFN-inducible p78, melanotransferrin (p97), human kallikrein (huK2), Axl, ROR2, FKBP11, KAMP3, ITGA8, FCRL5, LAGA-1, CD133, cD34, EBV nuclear antigen-1 (EBNA1), latent membrane protein 1 (LMP1) and LMP2A, CD75, gp100, MICA, MICB, MART 1, carcinoembryonic antigen, CA-125, MAGEC2, CTAG2, CTAG1, pd-12, CLA, CD142, CD73, CD49c, CD66c, CD104, CD318, TSPAN8, CLEC14, human immunodeficiency virus 1 (HIV-1) reverse transcriptase (RT), Cd16, BLTA, IL-2, IL-7, IL-15, IL-21, IL-12, CCR4, CCR2b, Heparanase, CD137L, LEM, and Bcl-2, Msln, Cd8, IL-15, 4-1BBL, OX40L, 4-IBB, cd95, cd27, HVENM, CXCR4; and any combination thereof. In some examples, the antigen to be targeted may be CXCR. In some examples, the antigen to be targeted may be PD-1.

In certain embodiments, an antigen to be targeted in adoptive cell therapy (such as particularly CAR or TCR T-cell therapy) of a disease (such as particularly of tumor or cancer) is a tumor-specific antigen (TSA).

In certain embodiments, an antigen to be targeted in adoptive cell therapy (such as particularly CAR or TCR T-cell therapy) of a disease (such as particularly of tumor or cancer) is a neoantigen.

In certain embodiments, an antigen to be targeted in adoptive cell therapy (such as particularly CAR or TCR T-cell therapy) of a disease (such as particularly of tumor or cancer) is a tumor-associated antigen (TAA).

In certain embodiments, an antigen to be targeted in adoptive cell therapy (such as particularly CAR or TCR T-cell therapy) of a disease (such as particularly of tumor or cancer) is a universal tumor antigen. In certain preferred embodiments, the universal tumor antigen is selected from the group consisting of: a human telomerase reverse transcriptase (hTERT), survivin, mouse double minute 2 homolog (MDM2), cytochrome P450 1B 1 (CYP1B), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53, cyclin (D1), and any combinations thereof.

In certain embodiments, an antigen (such as a tumor antigen) to be targeted in adoptive cell therapy (such as particularly CAR or TCR T-cell therapy) of a disease (such as particularly of tumor or cancer) may be selected from a group consisting of: CD19, BCMA, CD70, CLL-1, MAGE A3, MAGE A6, HPV E6, HPV E7, WT1, CD22, CD171, ROR1, MUC16, and SSX2. In certain preferred embodiments, the antigen may be CD19. For example, CD19 may be targeted in hematologic malignancies, such as in lymphomas, more particularly in B-cell lymphomas, such as without limitation in diffuse large B-cell lymphoma, primary mediastinal b-cell lymphoma, transformed follicular lymphoma, marginal zone lymphoma, mantle cell lymphoma, acute lymphoblastic leukemia including adult and pediatric ALL, non-Hodgkin lymphoma, indolent non-Hodgkin lymphoma, or chronic lymphocytic leukemia. For example, BCMA may be targeted in multiple myeloma or plasma cell leukemia (see, e.g., 2018 American Association for Cancer Research (AACR) Annual meeting Poster: Allogeneic Chimeric Antigen Receptor T Cells Targeting B Cell Maturation Antigen). For example, CLL1 may be targeted in acute myeloid leukemia. For example, MAGE A3, MAGE A6, SSX2, and/or KRAS may be targeted in solid tumors. For example, HPV E6 and/or HPV E7 may be targeted in cervical cancer or head and neck cancer. For example, WT1 may be targeted in acute myeloid leukemia (AML), myelodysplastic syndromes (MDS), chronic myeloid leukemia (CML), non-small cell lung cancer, breast, pancreatic, ovarian or colorectal cancers, or mesothelioma. For example, CD22 may be targeted in B cell malignancies, including non-Hodgkin lymphoma, diffuse large B-cell lymphoma, or acute lymphoblastic leukemia. For example, CD171 may be targeted in neuroblastoma, glioblastoma, or lung, pancreatic, or ovarian cancers. For example, ROR1 may be targeted in ROR1+ malignancies, including non-small cell lung cancer, triple negative breast cancer, pancreatic cancer, prostate cancer, ALL, chronic lymphocytic leukemia, or mantle cell lymphoma. For example, MUC16 may be targeted in MUC16ecto+ epithelial ovarian, fallopian tube or primary peritoneal cancer. For example, CD70 may be targeted in both hematologic malignancies as well as in solid cancers such as renal cell carcinoma (RCC), gliomas (e.g., GBM), and head and neck cancers (HNSCC). CD70 is expressed in both hematologic malignancies as well as in solid cancers, while its expression in normal tissues is restricted to a subset of lymphoid cell types (see, e.g., 2018 American Association for Cancer Research (AACR) Annual meeting Poster: Allogeneic CRISPR Engineered Anti-CD70 CAR-T Cells Demonstrate Potent Preclinical Activity Against Both Solid and Hematological Cancer Cells).

In some embodiments, the target antigen is a viral antigen. Many viral antigen targets have been identified and are known, including peptides derived from viral genomes in HIV, HTLV and other viruses (see e.g., Addo et al. (2007) PLoS ONE, 2, e321; Tsomides et al. (1994) J Exp Med, 180, 1283-93; Utz et al. (1996) J Virol, 70, 843-51). Exemplary viral antigens include, but are not limited to, an antigen from hepatitis A, hepatit s B (e.g., HBV core and surface antigens (HBVc, HBVs)), hepatitis C (HCV), Epstein-Ban* virus (e.g. EBVA), human papillomavirus (HPV; e.g. E6 and E7), human immunodeficiency type-1 virus (HIV1), Kaposi's sarcoma herpes virus (KSHV), human papilloma virus (HPV), influenza virus, Lassa virus, HTLN-i, HIN-1, HIN- IL CMN, EBN or HPN. In some embodiments, the target protein is a bacterial antigen or other pathogenic antigen, such as *Mycobacterium tuberculosis* (MT) antigens, trypanosome, e.g., *Tiypansoma cruzi* (*T. cruzi*), antigens such as surface antigen (TSA), or malaria antigens. Specific viral antigen or epitopes or other pathogenic antigens or peptide epitopes are known (see e.g., Addo et al. (2007) PLoS ONE, 2, e321; Anikeeva et al. (2009) Clin Immunol, 130, 98-109).

[0133] In some embodiments, the antigen is an antigen derived from a virus associated with cancer, such as an oncogenic virus. For example, an oncogenic virus is one in which infection from certain viruses are known to lead to the development of different types of cancers, for example, hepatitis A, hepatitis B (HB V), hepatitis C (HCV), human papilloma virus (HPV), hepatitis viral infections, Epstein-Barr virus (EBV), human herpes virus 8 (HHV-8), human T-cell leukemia virus-1 (HTLV-1), human T-cell leukemia virus-2 (HTLV-2), or a cytomegalovirus (CMV) antigen. In some embodiments, the viral antigen is an HPV antigen, which, in some cases, can lead to a greater risk of developing cervical and/or head and neck cancers. In some embodiments, the antigen can be a HPV-16 antigen, and HPV-18 antigen, and HPV-31 antigen, an HPV-33 antigen or an HPV-35 antigen. In some embodiments, the viral antigen is an HPV-16 antigens (e.g., seroreactive regions of the E1, E2, E6 or E7 proteins of HPV-16, see e.g., U.S. Pat. No. 6,531,127) or an HPV-18 antigens (e.g., seroreactive regions of the LI and/or L2 proteins of HPV-18, such as described in U.S. Pat. No. 5,840,306).

In some embodiments, the viral antigen is a HBV or HCV antigen, which, in some cases, can lead to a greater risk of developing liver cancer than HBV or HCV negative subjects. For example, in some embodiments, the heterologous antigen is an HBV antigen, such as a hepatitis B core antigen or a hepatitis B envelope antigen (US2012/0308580).

In some embodiments, the viral antigen is an EBV antigen, which, in some cases, can lead to a greater risk for developing Burkitt's lymphoma, nasopharyngeal carcinoma and Hodgkin's disease than EBV negative subjects. For example, EBV is a human herpes virus that, in some cases, is found associated with numerous human tumors of diverse tissue origin. While primarily found as an asymptomatic infection, EBV-positive tumors can be characterized by active expression of viral gene products, such as EBNA-1, LMP-1 and LMP-2A. In some embodiments, the heterologous antigen is an EBV antigen that can include Epstein-Barr nuclear antigen (EBNA)-1, EBNA-2, EBNA-3A, EBNA-3B, EBNA-3C, EBNA-leader protein (EBNA-LP), latent membrane proteins LMP-1, LMP-2A and LMP-2B, EBV-EA, EBV-MA or EBV-VCA. In some embodiments, the viral antigen is an HTLV-1 or HTLV-2 antigen, which, in some cases, can lead to a greater risk for developing T-cell leukemia than HTLV-1 or HTLV-2 negative subjects. For example, in some embodiments, the heterologous antigen is an HTLV-antigen, such as TAX.

In some embodiments, the viral antigen is a HHV-8 antigen, which, in some cases, can lead to a greater risk for developing Kaposi's sarcoma than HHV-8 negative subjects. In some embodiments, the heterologous antigen is a CMV antigen, such as pp65 or pp64 (see U.S. Pat. No. 8,361,473).

In some embodiments, the viral antigen is a virus-specific surface antigen such as an HIV-specific antigen (such as HIV gpl20); an EBV-specific antigen, a CMV-specific antigen, a HPV-specific antigen, a Lasse Virus-specific antigen, an Influenza Virus-specific antigen as well as any derivate or variant of these surface markers.

In one aspect, the present invention provides a treatment for tumors of the central nerve system, particularly induced by neurofibromatosis type 1 (NF1) neurogenetic conditions. individuals with NF1 are born with a germline mutation in the NF1 gene, but may develop numerous distinct neurological problems, ranging from autism and attention deficit to brain and peripheral nerve sheath tumors. The present invention may be used to develop a patient-specific disease model and to study induced pluripotent stem cell (iPSC)-derived disease relevant cells in an isogenic background. Embryonic stem cell (ESC)-like cells, also known as induced pluripotent stem cell or iPSC, can be generated from skin or blood cells in adult patients. recent research efforts have started to develop culture protocols that differentiate iPSCs into a variety of cell types in the central and peripheral nervous system (CNS and PNS), which are affected in NF1 patients. the CRISPR C2c1 system of this invention may be used to genetically edit the specific disease genes either by repairing the existing mutant genes or creating new mutations. In order to position at the forefront of NF1 research, it will be important for the Gilbert Family Neurofibromatosis Institute (GFNI) at the Children's National Medical Center to explore these recent exciting research developments, to systematically develop patient-specific human NF1 disease models, and to provide a tool for drug screening and evaluation on the individual NF patients.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoreponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

A person with ordinary skills in the art may use the CRISPR-C2c1 system disclosed in this invention in a similar system as described above. With respect to the C2c1 protein, the CRISPR-C2c1 system may recognize a PAM sequence that is a T-rich sequence. In some embodiments, the PAM sequence is 5' TTN 3' or 5' ATTN 3', wherein N is any nucleotide. In some embodiments, the CRISPR-C2c1 system introduces one or more staggered double strand breaks (DSBs) with a 5' overhang to the target gene. In particular embodiments, the 5' overhang is 7 nt. In some embodiments, the CRISPR-C2c1 system introduces a template DNA sequence at the staggered DSB via HR or NHEJ. In some particular embodiments, the CRISPR-C2c1 system comprises a catalytically inactivated C2c1 protein associated with a functional domain that modifies the target gene. In a particular embodiment, the CRISPR-C2c1 system introduces a single mutation. In another particular embodiment, the CRISPR-C2c1 system introduces a single nucleotide modification to the transcript of the target gene.

In one embodiment, the treatment can be administrated into patients undergoing an immunosuppressive treatment. The cells or population of cells may be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges. Dosing in CAR T cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells is administrated as a single dose. In another embodiment, the effective amount of cells is administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells is administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6):1107-15 (2010)).

In a further refinement of adoptive therapies, genome editing with a CRISPR-Cas system as described herein may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Cells may be edited using any CRISPR system and method of use thereof as described herein. CRISPR systems may be delivered to an immune cell by any method described herein. In preferred embodiments, cells are edited ex vivo and transferred to a subject in need thereof. Immunoresponsive cells, CAR T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

By inactivating a gene, it is intended that the gene of interest is not expressed in a functional protein form. In a particular embodiment, the CRISPR system specifically catalyzes cleavage in one targeted gene thereby inactivating said targeted gene. The nucleic acid strand breaks caused are commonly repaired through the distinct mechanisms of homologous recombination or non-homologous end joining (NHEJ). However, NHEJ is an imperfect repair process that often results in changes to the DNA sequence at the site of the cleavage. Repair via non-homologous end joining (NHEJ) often results in small insertions or deletions (Indel) and can be used for the creation of specific gene knockouts. Cells in which a cleavage induced mutagenesis event has occurred can be identified and/or selected by well-known methods in the art.

T cell receptors (TCR) are cell surface receptors that participate in the activation of T cells in response to the presentation of antigen. The TCR is generally made from two chains, $\alpha$ and $\beta$, which assemble to form a heterodimer and associates with the CD3-transducing subunits to form the T cell receptor complex present on the cell surface. Each $\alpha$ and $\beta$ chain of the TCR consists of an immunoglobulin-like N-terminal variable (V) and constant (C) region, a hydrophobic transmembrane domain, and a short cytoplasmic region. As for immunoglobulin molecules, the variable region of the $\alpha$ and $\beta$ chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCR$\alpha$ or TCR$\beta$ can result in the elimination of the TCR from the surface of T cells preventing recognition of alloantigen and thus GVHD. However, TCR disruption generally results in the elimination of the CD3 signaling component and alters the means of further T cell expansion.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1; 112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2):356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1, TIM-3, CEACAM-1, CEACAM-3, or CEACAM-5. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

The practice of the present invention employs, unless otherwise indicated, conventional techniques of immunology, biochemistry, chemistry, molecular biology, microbiology, cell biology, genomics and recombinant DNA, which are within the skill of the art. See MOLECULAR CLONING: A LABORATORY MANUAL, 2nd edition (1989) (Sambrook, Fritsch and Maniatis); MOLECULAR CLONING: A LABORATORY MANUAL, 4th edition (2012) (Green and Sambrook); CURRENT PROTOCOLS IN MOLECULAR BIOLOGY (1987) (F. M. Ausubel, et al. eds.); the series METHODS IN ENZYMOLOGY (Academic Press, Inc.); PCR 2: A PRACTICAL APPROACH (1995) (M. J. MacPherson, B. D. Hames and G. R. Taylor eds.); ANTIBODIES, A LABORATORY MANUAL (1988) (Harlow and Lane, eds.); ANTIBODIES A LABORATORY MANUAL, 2nd edition (2013) (E. A. Greenfield ed.); and ANIMAL CELL CULTURE (1987) (R.I. Freshney, ed.).

The practice of the present invention employs, unless otherwise indicated, conventional techniques for generation of genetically modified mice. See Marten H. Hofker and Jan van Deursen, TRANSGENIC MOUSE METHODS AND PROTOCOLS, 2nd edition (2011).

Screens/Diagnostics/Treatments Using CRISPR Systems

Cancer

The methods and compositions of the invention can be used to identify cell states, components, and mechanisms associated with drug-tolerance and persistence of disease cells. Terai et al. (Cancer Research, 19 Dec. 2017, doi: 10.1158/0008-5472.CAN-17-1904) reported a genome-wide CRISPR/Cas9 enhancer/suppressor screen in EGFR-dependent lung cancer PC9 cells treated with erlotinib+THZ1 (CDK7/12 inhibitor) combination therapy to identify multiple genes that enhanced erlotinib/THZ1 synergy, as well as components and pathways that suppress synergy. Wang et al.

(Cell Rep. 2017 Feb. 7; 18(6):1543-1557. doi: 10.1016/j.celrep.2017.01.031.; Krall et al., Elife. 2017 Feb. 1; 6. pii: e18970. doi: 10.7554/eLife.18970) reported the use of genome-wide CRISPR loss-of-function screens to identify mediator of resistance to MAPK inhibitors. Donovan et al. (PLoS One. 2017 Jan. 24; 12(1):e0170445. doi: 10.1371/journal.pone.0170445. eCollection 2017) used a CRISPR-mediated approach to mutagenesis to identify novel gain-of-function and drug resistant alleles of the MAPK signaling pathway genes. Wang et al. (Cell. 2017 Feb. 23; 168(5): 890-903.e15. doi: 10.1016/j.cell.2017.01.013. Epub 2017 Feb. 2) used genome-wide CRISPR screens to identify gene networks and synthetic lethal interactions with oncogenic Ras. Chow et al. (Nat Neurosci. 2017 October; 20(10):1329-1341. doi: 10.1038/nn.4620. Epub 2017 Aug. 14) developed an adeno-associated virus-mediated, autochthonous genetic CRISPR screen in glioblastoma to identify functional suppressors in glioblastoma. Xue et al. (Nature. 2014 Oct. 16; 514(7522):380-4. doi: 10.1038/nature13589. Epub 2014 Aug. 6) employed CRISPR-mediated direct mutation of cancer genes in the mouse liver.

Chen et al. (J Clin Invest. 2017 Dec. 4. pii: 90793. doi: 10.1172/JCI90793. [Epub ahead of print]) used a CRISPR-based screen to identify MYCN-amplified neuroblastoma dependency on EZH2. Support testing of EZH2 inhibitors in patients with MYCN-amplified neuroblastoma.

Vijai et al. (Cancer Discov. 2016 November; 6(11):1267-1275. Epub 2016 Sep. 21) reported use of CRISPR to generate heterozygous mutations in the mammary epithelial cell line to assess risk for breast cancer.

Chakraborty et al. (Sci Transl Med. 2017 Jul. 12; 9(398). pii: eaa15272. doi: 10.1126/scitranslmed.aa15272) used a CRISPR-based screen to identify EZH1 as potential target to treat clear cell renal cell carcinoma.

Metabolic Disease

The methods and compositions of the invention provide advantages over conventional gene therapy methods in the treatment of inherited metabolic diseases of the liver, including but not limited to familial hypercholesterolemia, hemophilia, ornithine transcarbamylase deficiency, hereditary tyrosinemia type 1, and alpha-1 antitrypsin deficiency. See, Bryson et al., Yale J. Biol. Med. 90(4):553-566, 19 Dec. 2017.

Bompada et al. (Int J Biochem Cell Biol. 2016 December; 81(Pt A):82-91. doi: 10.1016/j.biocel.2016.10.022. Epub 2016 Oct. 29) described the use of CRISPR to knockout histone acetyltransferase in pancreatic beta cells to demonstrate that histone acetylation serves as a key regulator of glucose-induced increase in TXNIP gene expression and thereby glucotoxicity-induced apoptosis.

Ocular

The invention provides efficient treatment of inherited and acquired ocular diseases of the retina. Holmgaard et al. (Mol. Ther. Nucleic Acids 9:89-99, 15 Dec. 2017 doi: 10.1016/j.omtn.2017.08.016. Epub 2017 Sep. 21) reported indel formation at high frequencies when SpCas9 was delivered by lentiviral vectors (LVs) encoding SpCas9 targeted to Vegfa and there was a significant reduction of of VEGFA in transduced cells. Duan et al. (J Biol Chem. 2016 Jul. 29; 291(31):16339-47. doi: 10.1074/jbc.M116.729467. Epub 2016 May 31) describe use of CRISPR to target MDM2 genomic locus in human primary retinal pigment epithelial cells.

The methods and compositions of the instant invention are similarly applicable to treatment of ocular diseases, including age-related macular degeneration.

Huang et al. (Nat Commun. 2017 Jul. 24; 8(1):112. doi: 10.1038/s41467-017-00140-3 employed CRISPR to edit VEGFR2 to treat angiogenesis-associated diseases.

Hearing

Gao et al. (Nature. 2017 Dec. 20. doi: 10.1038/nature25164. [Epub ahead of print]) reported genome editing using CRISPR-Cas9 to target Tmc1 gene in mice and reduce progressive hearing loss and deafness.

Muscle

Provenzano et al. (Mol Ther Nucleic Acids. 9:337-348. 15 Dec. 2017; doi: 10.1016/j.omtn.2017.10.006. Epub 2017 Oct. 14) reported CRISPR/Cas9-mediated deletion of CTG expansions and permanent reversion to a normal phenotype in myogenic cells from myotonic dystrophy 1 patients. The methods and compositions of the instant invention are similarly applicable to nucleotide repeat disorders, not limited to CTG expansions. Tabebordbar et al. (2016 Jan. 22; 351(6271):407-411. doi: 10.1126/science.aad5177. Epub 2015 Dec. 31) reports the use of CRISPR to edit the Dmd exon 23 locus to correct disruptive mutations in DMD. Tabebordbar shows that programmable CRISPR complexes can be delivered locally and systemically to terminally differentiated skeletal muscle fibers and cardiomyocytes, as well as muscle satellite cells, in neonatal and adult mice, where they mediate targeted gene modification, restore dystrophin expression and partially recover functional deficiencies of dystrophic muscle. See also Nelson et al., (Science. 2016 Jan. 22; 351(6271):403-7. doi: 10.1126/science.aad5143. Epub 2015 Dec. 31).

Infectious Disease

Sidik et al. (Cell. 2016 Sep. 8; 166(6):1423-1435.e12. doi: 10.1016/j.cell.2016.08.019. Epub 2016 Sep. 2) and Patel et al. (Nature. 2017 Aug. 31; 548(7669):537-542. doi: 10.1038/nature23477. Epub 2017 Aug. 7) describe a CRISPR screen in *Toxoplasma* and expansion of antiparasitic interventions.

There are several reports of genome-wide CRISPR screens to identify components and processes underlying host-pathogen interactions. Examples include Blondel et al. (Cell Host Microbe. 2016 Aug. 10; 20(2):226-37. doi: 10.1016/j.chom.2016.06.010. Epub 2016 Jul. 21), Shapiro et al. (Nat Microbiol. 2018 January; 3(1):73-82. doi: 10.1038/s41564-017-0043-0. Epub 2017 Oct. 23) and Park et al. (Nat Genet. 2017 February; 49(2):193-203. doi: 10.1038/ng.3741. Epub 2016 Dec. 19).

Ma et al. (Cell Host Microbe. 2017 May 10; 21(5):580-591.e7. doi: 10.1016/j.chom.2017.04.005) employed genome-wide CRISPR loss-of-function screens to identify viral transformation-driven synthetic lethal targets for therapeutic intervention. Cardiovascular diseases CRISPR systems can be used as to tool to identify genes or genetic variant associated with vascular disease. This is useful for identifying potential treatment or preventative targets. Xu et al. (Atherosclerosis, 2017 Sep. 21 pii: S0021-9150(17)31265-0. doi: 10.1016/j.atherosclerosis.2017.08.031. [Epub ahead of print]) reports the use of CRISPR to knockout the ANGPTL3 gene to confirm the role of ANGPTL3 in regulating plasma level of LDL-C. Gupta et al., (Cell. 2017 Jul. 27; 170(3):522-533.e15. doi: 10.1016/j.cell.2017.06.049) reports the use of CRISPR to edit stem cell-derived endothelial cells to identify genetic variant associated with vascular diseases. Beaudoin et al., (Arterioscler Thromb Vasc Biol. 2015 June; 35(6):1472-1479. doi: 10.1161/ATVBAHA.115.305534. Epub 2015 Apr. 2), reports the use of CRISPR genome editing to disrupt binding of the transcription factors MEF2 at the locus. This sets the stage for exploring how PHACTR1 functions in the vascular endothelium influence coronary artery disease. Pashos et al.

(Cell Stem Cell. 2017 Apr. 6; 20(4):558-570.e10. doi: 10.1016/j.stem.2017.03.017.) reports on using CRISPR technology to target pluripotent stem cells and hepatocyte-like cells to identify functional variants and lipid-functional genes.

In addition to being used as a tool for identifying targets, CRISPR systems can directly be used to treat or prevent cardiovascular diseases for known targets. Khera et al. (Nat Rev Genet. 2017 June; 18(6):331-344. doi: 10.1038/nrg.2016.160. Epub 2017 Mar. 13) described common variant association studies linking approximately 60 genetic loci to coronary risk used to facilitate a better understanding of causal risk factors, underlying biology development of new therapeutics. Khera explains, for example that inactivating mutations in PCSK9 decreased levels of circulating LDL cholesterol and reduced risk of CAD leading to intense interest in development of PCSK9 inhibitors. Further, antisense oligonucleotides designed to mimic protective mutations in APOC3 or LPA demonstrated a ~70% reduction in triglyceride levels and 80% reduction in circulating lipoprotein(a) levels, respectively. In addition, Wang et al., (Arterioscler Thromb Vasc Biol. 2016 May; 36(5):783-6. doi: 10.1161/ATVBAHA.116.307227. Epub 2016 Mar. 3) and Ding et al. (Circ Res. 2014 Aug. 15; 115(5):488-92. doi: 10.1161/CIRCRESAHA.115.304351. Epub 2014 Jun. 10.) report the use of CRISPR to target the gene Pcsk9 for the prevention of cardiovascular disease.

The invention provides methods and compositions for investigating and treating neurological diseases and disorders. Nakayama et al., (Am J Hum Genet. 2015 May 7; 96(5):709-19. doi: 10.1016/j.ajhg.2015.03.003. Epub 2015 Apr. 9) report use of CRISPR to study the role of PYCR2 in human CNS development and to identify potential target for microcephaly and hypomyelination. Swiech et al. (Nat Biotechnol. 2015 January; 33(1):102-6. doi: 10.1038/nbt.3055. Epub 2014 Oct. 19) report use of CRISPR to target single (Mecp2) as well as multiple genes (Dnmt1, Dnmt3a and Dnmt3b) in the adult mouse brain in vivo. Shin et al. (Hum Mol Genet. 2016 Oct. 15; 25(20):4566-4576. doi: 10.1093/hmg/ddw286) describes the use of CRISPR to inactivate Huntingon's disease mutation. Platt et al. (Cell Rep. 2017 Apr. 11; 19(2):335-350. doi: 10.1016/j.celrep.2017.03.052) report use of CRISPR knockin mice to identify Chd8's role in autism spectrum disorder. Seo et al. (J Neurosci. 2017 Oct. 11; 37(41):9917-9924. doi: 10.1523/JNEUROSCI.0621-17.2017. Epub 2017 Sep. 14) describe use of CRISPR to generate models of neurodegenerative disorders. Petersen et al. (Neuron. 2017 Dec. 6; 96(5):1003-1012.e7. doi: 10.1016/j.neuron.2017.10.008. Epub 2017 Nov. 2) demonstrate CRISPR knockout of activin A receptor type I in oligodendrocyte progenitor cells to identify potential targets for diseases with remyelination failure. The methods and compositions of the instant invention are similarly applicable.

Other Applications of CRISPR Technology.

Renneville et al (Blood. 2015 Oct. 15; 126(16):1930-9. doi: 10.1182/blood-2015-06-649087. Epub 2015 Aug. 28) report use of CRISPR to study the roles of EHMT1 and EMHT2 in fetal hemoglobin expression and to identify novel therapeutic target for SCD.

Tothova et al. (Cell Stem Cell. 2017 Oct. 5; 21(4):547-555.e8. doi: 10.1016/j.stem.2017.07.015) reported the use of CRISPR in hematopoietic stem and progenitor cells for generating models of human myeloid diseases.

Giani et al. (Cell Stem Cell. 2016 Jan. 7; 18(1):73-78. doi: 10.1016/j.stem.2015.09.015. Epub 2015 Oct. 22) report that inactivation of SH2B3 by CRISPR/Cas9 genome editing in human pluripotent stem cells allowed enhanced erythroid cell expansion with preserved differentiation.

Wakabayashi et al. (Proc Natl Acad Sci USA. 2016 Apr. 19; 113(16):4434-9. doi: 10.1073/pnas.1521754113. Epub 2016 Apr. 4) employed CRISPR to gain insight into GATA1 transcriptional activity and to investigate the pathogenicity of noncoding variants in human erythroid disorders.

Mandal et al. (Cell Stem Cell. 2014 Nov. 6; 15(5):643-52. doi: 10.1016/j.stem.2014.10.004. Epub 2014 November 6) describe CRISPR/Cas9 targeting of two clinically relevant genes, B2M and CCR5, in primary human CD4+ T cells and CD34+ hematopoietic stem and progenitor cells (HSPCs)

Polfus et al. (Am J Hum Genet. 2016 Sep. 1; 99(3):785. doi: 10.1016/j.ajhg.2016.08.002. Epub 2016 Sep. 1) used CRISPR to edit hematopoietic cell lines and follow-up targeted knockdown experiments in primary human hematopoietic stem and progenitor cells and investigate the role of GFI1B variants in human hematopoiesis.

Najm et al. (Nat Biotechnol. 2017 Dec. 18. doi: 10.1038/nbt.4048. [Epub ahead of print]) reports the use of CRISPR complex having a pair SaCas9 and SpCas9 to achieve dual targeting to generate high-complexity pooled dual-knockout libraries to identify synthetic lethal and buffering gene pairs across multiple cell types, including MAPK pathway genes and apoptotic genes.

Manguso et al. (Nature. 2017 Jul. 27; 547(7664):413-418. doi: 10.1038/nature23270. Epub 2017 Jul. 19.) reports the use of CRISPR screens to identify and/or confirm new immunotherapy targets. See also Roland et al. (Proc Natl Acad Sci USA. 2017 Jun. 20; 114(25):6581-6586. doi: 10.1073/pnas.1701263114. Epub 2017 Jun. 12.); Erb et al. (Nature. 2017 Mar. 9; 543(7644):270-274. doi: 10.1038/nature21688. Epub 2017 Mar. 1.); Hong et al., (Nat Commun. 2016 Jun. 22; 7:11987. doi: 10.1038/ncomms11987); Fei et al., (Proc Natl Acad Sci USA. 2017 Jun. 27; 114(26):E5207-E5215. doi: 10.1073/pnas.1617467114. Epub 2017 Jun. 13.); Zhang et al., (Cancer Discov. 2017 Sep. 29. doi: 10.1158/2159-8290.CD-17-0532. [Epub ahead of print]).

Joung et al. (Nature. 2017 Aug. 17; 548(7667):343-346. doi: 10.1038/nature23451. Epub 2017 Aug. 9.) reports the use of genome-wide screens to analyze long non-coding RNAs (lncRNA); see also Zhu et al., (Nat Biotechnol. 2016 December; 34(12):1279-1286. doi: 10.1038/nbt.3715. Epub 2016 Oct. 31); Sanjana et al., (Science. 2016 Sep. 30; 353(6307):1545-1549).

Barrow et al. (Mol Cell. 2016 Oct. 6; 64(1):163-175. doi: 10.1016/j.molcel.2016.08.023. Epub 2016 Sep. 22.) reports the use of genome-wide CRISPR screens to search for therapeutic targets for mitochondrial diseases. See also Vafai et al., (PLoS One. 2016 Sep. 13; 11(9):e0162686. doi: 10.1371/journal.pone.0162686. eCollection 2016).

Guo et al. (Elife. 2017 Dec. 5; 6. pii: e29329. doi: 10.7554/eLife.29329) reports the use of CRISPR to target human chondrocytes to elucidate biological mechanisms for human growth.

Ramanan et al. (Sci Rep. 2015 Jun. 2; 5:10833. doi: 10.1038/srep10833) reports the use of CRISPR to target and cleave conserved regions in the HBV genome.

Gene Drives

The present invention also contemplates use of the CRISPR-Cas system described herein, e.g., C2c1 effector protein systems, to provide RNA-guided gene drives, for example in systems analogous to gene drives described in PCT Patent Publication WO 2015/105928. Systems of this kind may for example provide methods for altering eukaryotic germline cells by introducing into the germline cell a nucleic acid sequence encoding an RNA-guided DNA nuclease and one or more guide RNAs. The guide RNAs may be designed to be complementary to one or more target locations on genomic DNA of the germline cell. The nucleic acid sequence encoding the RNA guided DNA nuclease and the nucleic acid sequence encoding the guide RNAs may be provided on constructs between flanking sequences, with promoters arranged such that the germline cell may express the RNA guided DNA nuclease and the guide RNAs, together with any desired cargo-encoding sequences that are also situated between the flanking sequences. The flanking sequences will typically include a sequence which is identical to a corresponding sequence on a selected target chromosome, so that the flanking sequences work with the components encoded by the construct to facilitate insertion of the foreign nucleic acid construct sequences into genomic DNA at a target cut site by mechanisms such as homologous recombination, to render the germline cell homozygous for the foreign nucleic acid sequence. In this way, gene-drive systems are capable of introgressing desired cargo genes throughout a breeding population (Gantz et al., 2015, Highly efficient Cas9-mediated gene drive for population modification of the malaria vector mosquito *Anopheles stephensi*, PNAS 2015, published ahead of print Nov. 23, 2015, doi: 10.1073/pnas.1521077112; Esvelt et al., 2014, Concerning RNA-guided gene drives for the alteration of wild populations eLife 2014; 3:e03401). In some embodiments, the invention provides a method for controlling insect borne diseases, including malaria, Zika virus, west nile virus, Japanese encephalitis virus, and Dengue virus, by a gene-drive system introgressing desired cargo genes throughout a breeding population of insects. In some embodiments, the gene-drive system is a CRISPR-C2c1 system. In particular embodiments, the insect is mosquito. In select embodiments, target sequences may be selected which have few potential off-target sites in a genome. Targeting multiple sites within a target locus, using multiple guide RNAs, may increase the cutting frequency and hinder the evolution of drive resistant alleles. Truncated guide RNAs may reduce off-target cutting. Paired nickases may be used instead of a single nuclease, to further increase specificity. Gene drive constructs may include cargo sequences encoding transcriptional regulators, for example to activate homologous recombination genes and/or repress non-homologous end-joining. Target sites may be chosen within an essential gene, so that non-homologous end-joining events may cause lethality rather than creating a drive-resistant allele. The gene drive constructs can be engineered to function in a range of hosts at a range of temperatures (Cho et al. 2013, Rapid and Tunable Control of Protein Stability in *Caenorhabditis elegans* Using a Small Molecule, PLoS ONE 8(8): e72393. doi:10.1371/journal.pone.0072393). The CRISPR-C2c1 system as disclosed herein may be applied to similar gene drive construct and systems as described in Ganz et al. and Cho et all. In certain embodiments, the CRISPR-C2c1 system modifies a gene involved in reproduction regulation. In some embodiments, the CRISPR-C2c1 system modifies a disease related gene. In certain embodiments, the CRISPR-C2c1 system modifies a livestock biomass related gene. In certain embodiments, the CRISPR-C2c1 system modifies a livestock trait related gene. In some embodiments, the trait related gene is involved in pest and fungal infection susceptibility. In particular embodiments, the CRISPR-C2c1 system is delivered to insect cells. In a particular embodiment, the insect cell is a honey bee cell. In some embodiments, the CRISPR-C2c1 system is delivered to an animal cell. In some embodiments, the CRISPR-C2c1 system is delivered to a non-human mammal cell. In particular embodiments, the trait related gene is involved in the regulation of adiposity. With respect to the C2c1 protein, the CRISPR-C2c1 system recognizes a PAM sequence that is T-rich. In some embodiments, the PAM is 5' TTN 3' or 5' ATTN 3', wherein N is any nucleotide. In some embodiments, the CRISPR-C2c1 system introduces one or more staggered double strand breaks (DSBs) with a 5' overhang. In particular embodiments, the 5' overhang is 7 nt. In some embodiments, the CRISPR-C2c1 system introduces an exogenous template DNA sequence at the staggered DSB via HR or NHEJ. In some embodiments, the C2c1 effector protein comprises one or more mutations. In some embodiments, the C2c1 effector protein is a nickase. In some particular embodiments, the CRISPR-C2c1 system comprises a catalytically inactivated C2c1 protein associated with a functional domain that modifies the target locus of interest. In a particular embodiment, the CRISPR-C2c1 system introduces a single mutation. In another particular embodiment, the CRISPR-C2c1 system introduces a single nucleotide modification to the transcript of the target locus of interest without modifying the genome of the livestock.

Xenotransplantation

The present invention also contemplates use of the CRISPR-Cas system described herein, e.g., C2c1 effector protein systems, to provide RNA-guided DNA nucleases adapted to be used to provide modified tissues for transplantation. For example, RNA-guided DNA nucleases may be used to knockout, knockdown or disrupt selected genes in an animal, such as a transgenic pig (such as the human heme oxygenase-1 transgenic pig line), for example by disrupting expression of genes that encode epitopes recognized by the human immune system, i.e., xenoantigen genes. Candidate porcine genes for disruption may for example include α(1,3)-galactosyltransferase and cytidine monophosphate-N-acetylneuraminic acid hydroxylase genes (see PCT Patent Publication WO 2014/066505). In addition, genes encoding endogenous retroviruses may be disrupted, for example the genes encoding all porcine endogenous retroviruses (see Yang et al., 2015, Genome-wide inactivation of porcine endogenous retroviruses (PERVs), Science 27 Nov. 2015: Vol. 350 no. 6264 pp. 1101-1104). In addition, RNA-guided DNA nucleases may be used to target a site for integration of additional genes in xenotransplant donor animals, such as a human CD55 gene to improve protection against hyperacute rejection.

General Gene Therapy Considerations

Examples of disease-associated genes and polynucleotides amd disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web.

Mutations in these genes and pathways can result in production of improper proteins or proteins in improper amounts which affect function. Further examples of genes, diseases and proteins are hereby incorporated by reference from U.S. Provisional application 61/736,527 filed Dec. 12, 2012. Such genes, proteins and pathways may be the target polynucleotide of a CRISPR complex of the present invention. Examples of disease-associated genes and polynucleotides are listed in Tables 7 and 8. Examples of signaling biochemical pathway-associated genes and polynucleotides are listed in Table 9

TABLE 7

| DISEASES/ DISORDERS | GENE(S) |
|---|---|
| Neoplasia | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Apc |
| Age-related Macular Degeneration | Abcr; Ccl2; Cc2; cp (ceruloplasmin); Timp3; cathepsinD; Vldlr; Ccr2 |
| Schizophrenia Disorders | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b 5-HTT (Slc6a4); COMT; DRD (Drd1a); SLC6A3; DAOA; DTNBP1; Dao (Dao1) |
| Trinucleotide Repeat Disorders | HTT (Huntington's Dx); SBMA/SMAX1/AR (Kennedy's Dx); FXN/X25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP-global instability); VLDLR (Alzheimer's); Atxn7; Atxn10 |
| Fragile X Syndrome | FMR2; FXR1; FXR2; mGLUR5 |
| Secretase Related Disorders | APH-1 (alpha and beta); Presenilin (Psen1); nicastrin (Ncstn); PEN-2 |
| Others | Nos1; Parp1; Nat1; Nat2 |
| Prion-related disorders | Prp |
| ALS | SOD1; ALS2; STEX; FUS; TARDBP; VEGF (VEGF-a; VEGF-b; VEGF-c) |
| Drug addiction | Prkce (alcohol); Drd2; Drd4; ABAT (alcohol); GRIA2; Grm5; Grin1; Htr1b; Grin2a; Drd3; Pdyn; Gria1 (alcohol) |
| Autism | Mecp2; BZRAP1; MDGA2; Sema5A; Neurexin 1; Fragile X (FMR2 (AFF2); FXR1; FXR2; Mglur5) |
| Alzheimer's Disease | E1; CHIP; UCH; UBB; Tau; LRP; PICALM; Clusterin; PS1; SORL1; CR1; Vldlr; Uba1; Uba3; CHIP28 (Aqp1, Aquaporin 1); Uchl1; Uchl3; APP |
| Inflammation | IL-10; IL-1 (IL-1a; IL-1b); IL-13; IL-17 (IL-17a (CTLA8); IL-17b; IL-17c; IL-17d; IL-17f); II-23; Cx3cr1; ptpn22; TNFa; NOD2/CARD15 for IBD; IL-6; IL-12 (IL-12a; IL-12b); CTLA4; Cx3cl1 |
| Parkinson's Disease | x-Synuclein; DJ-1; LRRK2; Parkin; PINK1 |

TABLE 8

| | |
|---|---|
| Blood and coagulation diseases and disorders | Anemia (CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT); Bare lymphocyte syndrome (TAPBP, TPSN, TAP2, ABCB3, PSF2, RING11, MHC2TA, C2TA, RFX5, RFXAP, RFX5), Bleeding disorders (TBXA2R, P2RX1, P2X1); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, FLJ34064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, KIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1). |
| Cell dysregulation and oncology diseases and disorders | B-cell non-Hodgkin lymphoma (BCL7A, BCL7); Leukemia (TAL1, TCL5, SCL, TAL2, FLT3, NBS1, NBS, ZNFN1A1, IK1, LYF1, HOXD4, HOX4B, BCR, CIVIL, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9546E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9546E, CAN, CAIN). |

TABLE 8-continued

| | |
|---|---|
| Inflammation and immune related diseases and disorders | AIDS (KIR3DL1, NKAT3, NKB1, AMB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), II-23, Cx3cr1, ptpn22, TNFa, NOD2/CARD15 for IBD, IL-6, IL-12 (IL-12a, IL-12b), CTLA4, Cx3cl1); Severe combined immunodeficiencies (SCIDs) (JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4). |
| Metabolic, liver, kidney and protein diseases and disorders | Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SC01), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). |
| Muscular/Skeletal diseases and disorders | Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EB S1); Osteopetrosis (LRP5, BMND1, LRP7, LR3, OPPG, VBCH2, CLCN7, CLC7, OPTA2, OSTM1, GL, TCIRG1, TIRC7, OC116, OPTB1); Muscular atrophy (VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1). |
| Neurological and neuronal diseases and disorders | ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCP1, ACE1, MPO, PACIP1, PAXIP1L, PTIP, A2M, BLMH, BMH, PSEN1, AD3); Autism (Mecp2, BZRAP1, MDGA2, Sema5A, Neurexin 1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJ1, PARK7, LRRK2, PARK8, PINK1, PARK6, UCHL1, PARKS, SNCA, NACP, PARK1, PARK4, PRKN, PARK2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cplx1), Tph1 Tryptophan hydroxylase, Tph2, Tryptophan hydroxylase 2, Neurexin 1, GSK3, GSK3a, GSK3b, 5-HTT (Slc6a4), COMT, DRD (Drd1a), SLC6A3, DAOA, DTNBP1, Dao (Dao1)); Secretase Related Disorders (APH-1 (alpha and beta), Presenilin (Psen1), nicastrin, (Ncstn), PEN-2, Nos1, Parp1, Nat1, Nat2); Trinucleotide Repeat Disorders (HTT (Huntington's Dx), SBMA/SMAX1/AR (Kennedy's Dx), FWX25 (Friedrich's Ataxia), ATX3 (Machado-Joseph's Dx), ATXN1 and ATXN2 (spinocerebellar ataxias), DMPK (myotonic dystrophy), Atrophin-1 and Atn1 (DRPLA Dx), CBP (Creb-BP-global instability), VLDLR (Alzheimer's), Atxn7, Atxn10). |
| Occular diseases and disorders | Age-related macular degeneration (Abcr, Ccl2, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, M1S1, VSX1, RINX, PPCD, |

TABLE 8-continued

| | |
|---|---|
| | PPD, KTCN, COL8A2, FECD, PPCD2, PIP5K3, CFD); Cornea plana congenital (KERA, CNA2); Glaucoma (MYOC, TIGR, GLC1A, JOAG, GPOA, OPTN, GLC1E, FIP2, HYPL, NRP, CYP1B1, GLC3A, OPA1, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2). |

TABLE 9

| CELLULAR FUNCTION | GENES |
|---|---|
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MIMP1; STAT1; IL6; HSP90AA1 |
| Axonal Guidance Signaling | PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT2; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK |
| Actin Cytoskeleton Signaling | ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |
| Huntington's Disease Signaling | PRKCE; IGF11; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |

TABLE 9-continued

| CELLULAR FUNCTION | GENES |
|---|---|
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MIMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MIMP1; MIMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; PMAIP1; CHEK2; TNFRSF10B ; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3 |
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F 1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQ01; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1 |
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ |
| NF-KB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |

TABLE 9-continued

| CELLULAR FUNCTION | GENES |
|---|---|
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1 |
| IL-6 Signaling | HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS2; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MIMP1; STAT1; IL6; CTGF; MIMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 |
| Fc Epsilon RI Signaling | PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA |
| G-Protein Coupled Receptor Signaling | PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |

TABLE 9-continued

| CELLULAR FUNCTION | GENES |
|---|---|
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; AKT1; PIK3R1; STAT3; MAP2K1; FGFR4; CRKL; ATF4; AKT3; PRKCA; HGF |
| GM-CSF Signaling | LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; S TAT1 |
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK |
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS53; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCA1; UCHL1; NEDD4; CBL; UBE2I; BTRC; HSPA5; USP7; USP10; FBW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |
| EGF Signaling | ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1 |

TABLE 9-continued

| CELLULAR FUNCTION | GENES |
|---|---|
| Hypoxia Signaling in the HSP90AA1 Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; |
| LPS/IL-1 Mediated | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |
| Inhibition of RXR Function | |
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MIMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| cAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBP1; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/ Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GLI1; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Aminosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |

TABLE 9-continued

| CELLULAR FUNCTION | GENES |
|---|---|
| Glutathione Metabolism | IDH2; GSTP1; ANPEP; IDH1 |
| Glycerolipid Metabolism | ALDH1A1; GPAM; SPHK1; SPHK2 |
| Linoleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |
| Propanoate Metabolism | ALDH1A1; LDHA |
| Selenoamino Acid Metabolism | PRMT5; AHCY |
| Sphingolipid Metabolism | SPHK1; SPHK2 |
| Aminophosphonate Metabolism | PRMT5 |
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |
| Glutamate Receptor Signaling | GNB2L1 |
| NRF2-mediated Oxidative Stress Response | PRDX1 |
| Pentose Phosphate Pathway | GPI |

TABLE 9-continued

| CELLULAR FUNCTION | GENES |
|---|---|
| Pentose and Glucuronate Interconversions | UCHL1 |
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab 1; unc-86 (Pou4f1 or Brn3a); Numb; Reln |

Embodiments of the invention also relate to methods and compositions related to knocking out genes, amplifying genes and repairing particular mutations associated with DNA repeat instability and neurological disorders (Robert D. Wells, Tetsuo Ashizawa, Genetic Instabilities and Neurological Diseases, Second Edition, Academic Press, Oct. 13, 2011—Medical). Specific aspects of tandem repeat sequences have been found to be responsible for more than twenty human diseases (New insights into repeat instability: role of RNA•DNA hybrids. McIvor EI, Polak U, Napierala M. RNA Biol. 2010 September-October; 7(5):551-8). The present effector protein systems may be harnessed to correct these defects of genomic instability.

Several further aspects of the invention relate to correcting defects associated with a wide range of genetic diseases which are further described on the website of the National Institutes of Health under the topic subsection Genetic Disorders (website at health.nih.gov/topic/GeneticDisorders). The genetic brain diseases may include but are not limited to Adrenoleukodystrophy, Agenesis of the Corpus Callosum, Aicardi Syndrome, Alpers' Disease, Alzheimer's Disease, Barth Syndrome, Batten Disease, CADASIL, Cerebellar Degeneration, Fabry's Disease, Gerstmann-Straussler-Scheinker Disease, Huntington's Disease and other Triplet Repeat Disorders, Leigh's Disease, Lesch-Nyhan Syndrome, Menkes Disease, Mitochondrial Myopathies and NINDS Colpocephaly. These diseases are further described on the website of the National Institutes of Health under the subsection Genetic Brain Disorders.

Throughout this disclosure there has been mention of CRISPR or CRISPR-Cas complexes or systems. CRISPR systems or complexes can target nucleic acid molecules, e.g., CRISPR-C2c1 complexes can target and cleave or nick or simply sit upon a target DNA molecule (depending if the C2c1 has mutations that render it a nickase or "dead"). Such systems or complexes are amenable for achieving tissue-specific and temporally controlled targeted deletion of candidate disease genes. Examples include but are not limited to genes involved in cholesterol and fatty acid metabolism, amyloid diseases, dominant negative diseases, latent viral infections, among other disorders. Accordingly, target sequences for such systems or complexes can be in candidate disease genes, e.g.:

TABLE 10

Diseases and Targets

| Disease | GENE | SPACER | PAM | Mechanism | References |
|---|---|---|---|---|---|
| Hyper-choles-terolemia | HMG-CR | GCCAAATT GGACGACC CTCG (SEQ ID NO: 480) | CGG | Knock-out | Fluvastatin: a review of its pharm-acology and use in the management of hyper-cholester-olemia. (Plosker GL et al. Drugs 1996, 51(3): 433-459) |
| Hyper-choles-terolemia | SQLE | CGAGGAGA CCCCCGTT TCGG (SEQ ID NO: 481) | TGG | Knock-out | Potential role of nonstatin cholesterol lowering agents (Trapani et al. IUBMB Life, Volume 63, |

TABLE 10-continued

| Diseases and Targets | | | | | |
|---|---|---|---|---|---|
| Disease | GENE | SPACER | PAM | Mechanism | References |
| | | | | | Issue 11, pages 964-971, November 2011) |
| Hyper-lipidemia | DGAT 1 | CCCGCCGC CGCCGTGG CTCG (SEQ ID NO: 482) | AGG | Knock-out | DGAT1 inhibitors as anti-obesity and anti-diabetic agents. (Birch A M et al. Current Opinion in Drug Discovery & Development [2010, 13(4): 489-496) |
| Leukemia | BCR-ABL | TGAGCTCT ACGAGATC CACA (SEQ ID NO: 483) | AGG | Knock-out | Killing of leukemic cells with a BCR/ABL fusion gene by RNA interference (RNAi). (Fuchs et al. Oncogene 2002, 21(37): 5716-5724) |

Thus, the present invention, with regard to CRISPR or CRISPR-Cas complexes contemplates correction of hematopoietic disorders. For example, Severe Combined Immune Deficiency (SCID) results from a defect in lymphocytes T maturation, always associated with a functional defect in lymphocytes B (Cavazzana-Calvo et al., Annu. Rev. Med., 2005, 56, 585-602; Fischer et al., Immunol. Rev., 2005, 203, 98-109). In the case of Adenosine Deaminase (ADA) deficiency, one of the SCID forms, patients can be treated by injection of recombinant Adenosine Deaminase enzyme. Since the ADA gene has been shown to be mutated in SCID patients (Giblett et al., Lancet, 1972, 2, 1067-1069), several other genes involved in SCID have been identified (Cavazzana-Calvo et al., Annu. Rev. Med., 2005, 56, 585-602; Fischer et al., Immunol. Rev., 2005, 203, 98-109). There are four major causes for SCID: (i) the most frequent form of SCID, SCID-X1 (X-linked SCID or X-SCID), is caused by mutation in the IL2RG gene, resulting in the absence of mature T lymphocytes and NK cells. IL2RG encodes the gamma C protein (Noguchi, et al., Cell, 1993, 73, 147-157), a common component of at least five interleukin receptor complexes. These receptors activate several targets through the JAK3 kinase (Macchi et al., Nature, 1995, 377, 65-68), which inactivation results in the same syndrome as gamma C inactivation; (ii) mutation in the ADA gene results in a defect in purine metabolism that is lethal for lymphocyte precursors, which in turn results in the quasi absence of B, T and NK cells; (iii) V(D)J recombination is an essential step in the maturation of immunoglobulins and T lymphocytes receptors (TCRs). Mutations in Recombination Activating Gene 1 and 2 (RAG1 and RAG2) and Artemis, three genes involved in this process, result in the absence of mature T and B lymphocytes; and (iv) Mutations in other genes such as CD45, involved in T cell specific signaling have also been reported, although they represent a minority of cases (Cavazzana-Calvo et al., Annu. Rev. Med., 2005, 56, 585-602; Fischer et al., Immunol. Rev., 2005, 203, 98-109). In aspect of the invention, relating to CRISPR or CRISPR-Cas complexes contemplates system, the invention contemplates that it may be used to correct ocular defects that arise from several genetic mutations further described in Genetic Diseases of the Eye, Second Edition, edited by Elias I. Traboulsi, Oxford University Press, 2012. Non-limiting examples of ocular defects to be corrected include macular degeneration (MD), retinitis pigmentosa (RP). Non-limiting examples of genes and proteins associated with ocular defects include but are not limited to the following proteins: (ABCA4) ATP-binding cassette, sub-family A (ABC1), member 4 ACHM1 achromatopsia (rod monochromacy) 1 ApoE Apolipoprotein E (ApoE) C1QTNF5 (CTRP5) C1q and tumor necrosis factor related protein 5 (C1QTNF5) C2 Complement component 2 (C2) C3 Complement components (C3) CCL2 Chemokine (C-C motif) Ligand 2 (CCL2) CCR2 Chemokine (C-C motif) receptor 2 (CCR2) CD36 Cluster of Differentiation 36 CFB Complement factor B CFH Complement factor CFH H CFHR1 complement factor H-related 1 CFHR3 complement factor H-related 3 CNGB3 cyclic nucleotide gated channel beta 3 CP ceruloplasmin (CP) CRP C reactive protein (CRP) CST3 cystatin C or cystatin 3 (CST3) CTSD Cathepsin D (CTSD) CX3CR1 chemokine (C-X3-C motif) receptor 1 ELOVL4 Elongation of very long chain fatty acids 4 ERCC6 excision repair cross-complementing rodent repair deficiency, complementation group 6 FBLN5 Fibulin-5 FBLN5 Fibulin 5 FBLN6 Fibulin 6 FSCN2 fascin (FSCN2) HMCN1 Hemicentrin 1 HMCN1 hemicentin 1 HTRA1 HtrA serine peptidase 1 (HTRA1) HTRA1 HtrA serine peptidase 1 IL-6 Interleukin 6 IL-8 Interleukin 8 LOC387715 Hypothetical protein PLEKHA1 Pleckstrin homology domain-containing family A member 1 (PLEKHA1) PROM1 Prominin 1 (PROM1 or CD133) PRPH2 Peripherin-2 RPGR retinitis pigmentosa GTPase regulator SERPINGI serpin peptidase inhibitor, clade G, member 1 (C1-inhibitor) TCOF1 Treacle TIMP3 Metalloproteinase inhibitor 3 (TIMP3) TLR3 Toll-like receptor 3 The present invention, with regard to CRISPR or CRISPR-Cas complexes contemplates also contemplates delivering to the heart. For the heart, a myocardium tropic adena-associated virus (AAVM) is preferred, in particular AAVM41 which showed preferential gene transfer in the heart (see, e.g., Lin-Yanga et al., PNAS, Mar. 10, 2009, vol. 106, no. 10). For example, US Patent Publication No. 20110023139, describes use of zinc finger nucleases to genetically modify cells, animals and proteins associated with cardiovascular disease. Cardiovascular diseases generally include high blood pressure, heart attacks, heart failure, and stroke and TIA. By way of example, the chromosomal sequence may comprise, but is not limited to, IL1B (interleukin 1, beta), XDH (xanthine dehydrogenase), TP53 (tumor protein p53), PTGIS (prostaglandin 12 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin 12 (prostacyclin) receptor (IP)), KCNJ11

(potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (*C. elegans*)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), VWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3 (coagulation factor III (thromboplastin, tissue factor)), CST3 (cystatin C), COG2 (component of oligomeric golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein 111a, antigen CD61)), CAT (catalase), UTS2 (urotensin 2), THBD (thrombomodulin), F10 (coagulation factor X), CP (ceruloplasmin (ferroxidase)), TNFRSF11B (tumor necrosis factor receptor superfamily, member 11b), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, sub-family B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF1 (upstream transcription factor 1), CFH (complement factor H), HSPA4 (heat shock 70 kDa protein 4), MMP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-1-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and VIIIa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CABIN1 (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SP1 (Sp1 transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), I1L2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member A1), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IL17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, A1 polypeptide), TTR (transthyretin), FABP4 (fatty acid binding protein 4, adipocyte), PON3 (paraoxonase 3), APOC1 (apolipoprotein C-I), INSR (insulin receptor), TNFRSF1B (tumor necrosis factor receptor superfamily, member 1), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (*Drosophila*)), UGT1A1 (UDP glucuronosyltransferase 1 family, polypeptide A1), IFNA1 (interferon, alpha 1), PPARD (peroxisome proliferator-activated receptor delta), SIRT1 (sirtuin (silent mating type information regulation 2 homolog) 1 (*S. cerevisiae*)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gpl30, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF 11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member A1 (aldehyde reductase)), ALDH9A1 (aldehyde dehydrogenase 9 family, member A1), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin L1), PCNA (proliferating cell nuclear antigen), IGF2 (insulin-like growth factor 2 (somatomedin A)), ITGB1 (integrin, beta 1 (fibronectin receptor, beta polypeptide, antigen CD29 includes MDF2, MSK12)), CAST (calpastatin), CXCL 12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C-C motif) ligand 5), IRF1 (interferon regulatory factor 1), CFLAR (CASP8 and FADD-like apoptosis regulator), CALCA (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PECAM1 (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (*S. cerevisiae*)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-.beta.-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (B321 placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene C4 synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHCl (SHC (Src homology 2 domain containing) transforming protein 1), LRP1 (low density lipoprotein receptor-related protein 1), SOCS3 (suppressor of cytokine signaling 3), ADH1B (alcohol dehydrogenase 1B (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor H1), NR112 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity IIa, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCHE (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase kinase 5), CHGA (chromogranin A (parathyroid secretory protein 1)), IAPP (islet amyloid polypeptide), RHO (rhodopsin), ENPP1 (ectonucleotide pyrophosphatase/phosphodiesterase 1), PTHLH (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha-), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISH (cytokine inducible SH2-containing protein), GAST (gastrin), MYOC (myocilin, trabecular meshwork inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), HSF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTH (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOH (apolipoprotein H (beta-2-glycoprotein I)), S100A8 (S100 calcium binding protein A8), IL11 (interleukin 11), ALOX15 (arachidonate 15-lipoxygenase), FBLN1 (fibulin 1), NR1H3 (nuclear receptor subfamily 1, group H, member 3), SCD (stearoyl-CoA desaturase (delta-9-desaturase)), GIP (gastric inhibitory polypeptide), CHGB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), HSD11B2 (hydroxysteroid (11-beta) dehydrogenase 2), CALCRL (calcitonin receptor-like), GALNT2 (UDP-N-acetyl-alpha-D-galactosamine.polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adenovirus E1B 19 kDa interacting protein 3), GCKR (glucokinase (hexokinase 4) regulator), S100A12 (S100 calcium binding protein A12), *PADI*4 (peptidyl arginine deiminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), IDDM2 (insulin-dependent diabetes mellitus 2), RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNAlC (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11A (tumor necrosis factor receptor superfamily, member 11 a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol (myo)-1 (or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L 1 (chitinase 3-like 1 (cartilage glycoprotein-39)), ALDH1B1 (aldehyde dehydrogenase 1 family, member B1), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), F11R (F11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), KHK (ketohexokinase (fructokinase)), SAT1 (spermidine/spermine N1-acetyltransferase 1), GGH (gamma-glutamyl hydrolase (conjugase, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RHOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-Sep(15 kDa selenoprotein), CILP2 (cartilage intermediate layer protein 2), TERC (telomerase RNA component), GGT2 (gamma-glutamyltransferase 2), MT-CO1 (mitochondrially encoded cytochrome c oxidase I), and UOX (urate oxidase, pseudogene). In an additional embodiment, the chromosomal sequence may further be selected from Pon1 (paraoxonase 1), LDLR (LDL receptor), ApoE (Apolipoprotein E), Apo B-100 (Apolipoprotein B-100), ApoA (Apolipoprotein(a)), ApoA1 (Apolipoprotein A1), CBS (Cystathione B-synthase), Glycoprotein IIb/IIb, MTHRF (5,10-methylenetetrahydrofolate reductase (NADPH), and combinations thereof. In one iteration, the chromosomal sequences and proteins encoded by chromosomal sequences involved in cardiovascular disease may be chosen from Cacna1C, Sod1, Pten, Ppar(alpha), Apo E, Leptin, and combinations thereof. The text herein accordingly provides exemplary targets as to CRISPR or CRISPR-Cas systems or complexes.

IMMUNE ORTHOGONAL ORTHOLOGS

In some embodiments, when CRISPR enzymes need to be expressed or administered in a subject, immunogenicity of CRISPR enzymes may be reduced by sequentially expressing or administering immune orthogonal orthologs of CRISPR enzymes to the subject. As used herein, the term "immune orthogonal orthologs" refer to orthologous proteins that have similar or substantially the same function or activity, but have no or low cross-reactivity with the immune response generated by one another. Sequential expression or administration of such orthologs may not elicit robust or any secondary immune response. The immune orthogonal orthologs can avoid neutralization by existing antibodies. Cells expressing the orthologs can avoid clearance by the host's immune system (e.g., by activated CTLs). In some examples, CRISPR enzyme orthologs from different species may be immune orthogonal orthologs.

Immune orthogonal orthologs may be identified by analyzing the sequences, structures, and immunogenicity of a set of candidates orthologs. In an example method, a set of immune orthogonal orthologs may be identified by a) comparing the sequences of a set of candidate orthologs (e.g., orthologs from different species) to identify a subset of candidates that have low or no sequence similarity; b) assessing immune overlap among the members of the subset of candidates to identify candidates that have no or low immune overlap. In some cases, immune overlap among candidates may be assessed by determining the binding (e.g., affinity) between a candidate ortholog and MHC (e.g., MHC type I and/or MHC II). Alternatively or additionally, immune overlap among candidates may be assessed by determining B-cell epitopes for the candidate orthologs. In one example, immune orthogonal orthologs may be identified using method described in Moreno A M et al., BioRxiv, published online Jan. 10, 2018, doi: doi.org/10.1101/245985.

The present application also provides aspects and embodiments as set forth in the following numbered Statements:

1. A non-naturally occurring or engineered system comprising: i) a Cas12b effector protein from Table 1 or 2, ii) a guide comprising a guide sequence capable of hybridizing to a target sequence.

2. The system of statement 1, wherein the Cas12b effector protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

3. The system of statement 1 or 2, wherein the tracr RNA is fused to the crRNA at the 5' end of the direct repeat sequence.

4. The system of any one of the preceding statements, which comprises two or more guide sequences capable of hybridizing two different target sequences or different regions of the same target sequence.

5. The system of any one of the preceding statements, wherein the guide sequence hybridizes to one or more target sequences in a prokaryotic cell.

6. The system of any one of the preceding statements, wherein the guide sequence hybridizes to one or more target sequences in a eukaryotic cell.

7. The system of any one of the preceding statements, wherein the Cas12b effector protein comprises one or more nuclear localization signals (NLSs).

8. The system of any one of the preceding statements, wherein the Cas12b effector protein is catalytically inactive.

9. The system of any one of the preceding statements, wherein the Cas12b effector protein is associated with one or more functional domains.

10. The system of statement 9, wherein the one or more functional domains cleaves the one or more target sequences.

11. The system of statement 10, wherein the functional domain modifies transcription or translation of the one or more target sequences.

12. The system of any one of the preceding statements, wherein the Cas12b effector protein is associated with one or more functional domains; and the Cas12b effector protein contains one or more mutations within a RuvC and/or Nuc domain, whereby the formed CRISPR complex is capable of delivering an epigenetic modifier or a transcriptional or translational activation or repression signal at or adjacent to a target sequence.

13. The system of any one of the preceding statements, wherein the Cas12b effector protein is associated with an adenosine deaminase or cytidine deaminase.

14. The system of any one of the preceding statements further comprising a recombination template.

15. The system of statement 14, wherein the recombination template is inserted by homology-directed repair (HTDR).

16. A Cas12b vector system, which comprises one or more vectors comprising: a first regulatory element operably linked to a nucleotide sequence encoding a Cas12b effector protein from Table 1 or 2, and i) a) a second regulatory element operably linked to a nucleotide sequence encoding the guide sequence, and b) a third regulatory element operably linked to a nucleotide sequence encoding the tracr RNA, or ii) a second regulatory element operably linked to a nucleotide sequence encoding the guide sequence and the tracr RNA.

17. The vector system of statement 16, wherein the nucleotide sequence encoding the Cas12b effector protein is codon optimized for expression in a eukaryotic cell.

18. The vector system of statement 16 or 17, which is comprised in a single vector.

19. The vector system of any of statements 17 to 18, wherein the one or more vectors comprise viral vectors.

20. The vector system of any of statements 17 to 19, wherein the one or more vectors comprise one or more retroviral, lentiviral, adenoviral, adeno-associated or herpes simplex viral vectors.

21. A delivery system configured to deliver a Cas12b effector protein and one or more nucleic acid components of a non-naturally occurring or engineered composition comprising: i) Cas12b effector protein selected from Table 1 or 2, ii) a guide sequence that is capable of hybridizing to one or more target sequences, and iii) a tracr RNA.

22. The delivery system of statement 21, which comprises one or more vectors, or one or more polynucleotide molecules, the one or more vectors or polynucleotide molecules comprising one or more polynucleotide molecules encoding the Cas12b effector protein and one or more nucleic acid components of the non-naturally occurring or engineered composition.

23. The delivery system of statement 21 or 22, which comprises a delivery vehicle comprising liposome(s), particle(s), exosome(s), microvesicle(s), a gene-gun, or viral vector(s).

24. The non-naturally occurring or engineered system of any one of statements 1 to 15, vector system of any one of statements 16 to 20, or delivery system of any one of statements 21 to 23, for use in a therapeutic method of treatment.

25. A method of modifying one or more target sequences of interest, the method comprising contacting one or more target sequences with one or more non-naturally occurring or engineered compositions comprising: i) a Cas12b effector protein from Table 1 or 2, ii) a guide sequence that is capable of hybridizing to one or more target sequences, and iii) a tracr RNA, whereby there is formed a CRISPR complex comprising the Cas12b effector protein complexed with the crRNA and the tracr RNA, wherein the guide sequence directs sequence-specific binding to the one or more target sequences sequence in a cell, whereby expression of one or more target sequences is modified.

26. The method of statement 25, wherein modifying the one or more target sequences comprises cleaving the target DNA.

27. The method of statement 25 or 26, wherein modifying the one or more target sequences comprises increasing or decreasing expression of the one or more target sequences.

28. The method of any of statements 25 to 27, wherein the composition further comprises a recombination template, and wherein modifying the one or more target sequences comprises insertion of the recombination template or a portion thereof.

29. The method of any of statements 25 to 28, wherein the target gene is in a prokaryotic cell.

30. The method of any of statements 25 to 29, wherein the one or more target sequences is in a eukaryotic cell.

31. A cell or progeny thereof comprising a modified target of interest, wherein the one or more target sequences has been modified according to the method of any of statements 25 to 30 optionally a therapeutic T cell or antibody-producing B-cell or wherein said cell is a plant cell.

32. The cell of statement 31, wherein the cell is a prokaryotic cell.

33. The cell of statement 31, wherein the cell is a eukaryotic cell.

34. The cell according to any of statements 31 to 33, wherein the modification of the one or more target sequences results in: the cell comprising altered expression of at least one gene product; the cell comprising altered expression of at least one gene product, wherein the expression of the at least one gene product is increased; or the cell comprising altered expression of at least one gene product, wherein the expression of the at least one gene product is decreased or a cell or population that produces and/or secretes an endogenous or non-endogenous biological product or chemical compound.

35. The eukaryotic cell according to statement 31 or 34, wherein the cell is a mammalian cell or a human cell.

36. A cell line of or comprising the cell according to any one of statements 31 to 35, or progeny thereof.

37. A multicellular organism comprising one or more cells according to any one of statements 31 to 35.

38. A plant or animal model comprising one or more cells according to any one of statements 31 to 35.

39. A gene product from a cell of any one of statements 31 to 35 or the cell line of statement 36 or the organism of statement 37 or the plant or animal model of statement 38.

40. The gene product of statement 39, wherein the amount of gene product expressed is greater than or less than the amount of gene product from a cell that does not have altered expression.

41. An isolated Cas12b effector protein from Table 1 or 2.

42. An isolated nucleic acid encoding the Cas12b effector protein of statement 41.

43. The isolated nucleic acid according to statement 42, which is a DNA and further comprises a sequence encoding a crRNA and a tracr RNA.

44. An isolated eukaryotic cell comprising the nucleic acid according to statement 42 or 43 or the Cas12b of statement 41.

45. A non-naturally occurring or engineered system comprising: i) an mRNA encoding a Cas12b effector protein from Table 1 or 2, ii) a guide sequence, and iii) a tracr RNA.

46. The non-naturally occurring or engineered system according to statement 45, wherein the tracr RNA is fused to the crRNA at the 5' end of the direct repeat.

47. An engineered composition for site directed base editing comprising a targeting domain and an adenosine deaminase, cytidine deaminase, or catalytic domain thereof, wherein the targeting domain comprise a Cas12b effector protein, or fragment thereof which retains oligonucleotide-binding activity and a guide molecule.

48. The composition of statement 47, wherein the Cas12b effector protein is catalytically inactive.

49. The composition of statement 47 or 48, wherein the Cas12b effector protein is selected from Table 1 or 2.

50. The composition of any one of statements 47-49, protein wherein the Cas12b effector protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

51. A method of modifying an adenosine or cytidine in one or more target oligonucleotides of interest, comprising delivering to said one or more target oligonucleotides, the composition according to any one of statements 47 to 50.

52. The method of statement 51, wherein the for use in the treatment or prevention of a disease caused by transcripts containing a pathogenic T→C or A→G point mutation.

53. An isolated cell obtained from the method of any one of statement 51 or 52 and/or comprising the composition of any one of statements 47-50.

54. The cell or progeny thereof of statement 53, wherein said eukaryotic cell, preferably a human or non-human animal cell, optionally a therapeutic T cell or antibody-producing B-cell or wherein said cell is a plant cell.

55. A non-human animal comprising said modified cell or progeny thereof of statements 53 or 54.

56. A plant comprising said modified cell of statement 54.

57. A modified cell according to statement 53 or 54 for use in therapy, preferably cell therapy.

58. A method of modifying an adenine or cytosine in a target oligonucleotide, comprising delivering to said target oligonucleotide: a catalytically inactive Cas12b protein; a guide molecule which comprises a guide sequence linked to a direct repeat; and an adenosine or cytidine deaminase protein or catalytic domain thereof; wherein said adenosine or cytidine deaminase protein or catalytic domain thereof is covalently or non-covalently linked to said catalytically inactive Cas12b protein or said guide molecule or is adapted to linked thereto after delivery; wherein said guide molecule forms a complex with said catalytically inactive Cas12b and directs said complex to bind said target oligonucleotide, wherein said guide sequence is capable of hybridizing with a target sequence within said target oligonucleotide to form an oligonucleotide duplex.

59. The method of statement 58, wherein: (A) said Cytosine is outside said target sequence that forms said oligonucleotide duplex, wherein said cytidine deaminase protein or catalytic domain thereof deaminates said Cytosine outside said oligonucleotide duplex, or (B) said Cytosine is within said target sequence that forms said oligonucleotide duplex, wherein said guide sequence comprises a non-pairing Adenine or Uracil at a position corresponding to said Cytosine resulting in a C-A or C-U mismatch in said RNA duplex, and wherein the cytidine deaminase protein or catalytic domain thereof deaminates the Cytosine in the oligonucleotide duplex opposite to the non-pairing Adenine or Uracil.

60. The method of statement 58 or 59, said adenosine deaminase protein or catalytic domain thereof deaminates said Adenine or Cytosine in said oligonucleotide duplex.

61. The method of any one of statements 58-60, wherein the Cas12b protein is selected from Table 1 or 2.

62. The method of statement 61, wherein the Cas12b protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

63. A system for detecting the presence of nucleic acid oligonucleotide target sequences in one or more in vitro samples, comprising: a Cas12b protein; at least one guide polynucleotide comprising a guide sequence designed to have a degree of complementarity with the one or more target sequences, and designed to form a complex with the Cas12b protein; and an oligonucleotide-based masking construct comprising a non-target sequence; wherein the Cas12b protein exhibits collateral nuclease activity and cleaves the non-target sequence of the oligo-nucleotide based masking construct once activated by the one or more target sequences.

64. A system for detecting the presence of target polypeptides in one or more in vitro samples comprising: a Cas12b protein; one or more detection aptamers, each designed to bind to one of the one or more target polypeptides, each detection aptamer comprising a masked promoter binding site or masked primer binding site and a trigger sequence template; and an oligonucleotide-based masking construct comprising a non-target sequence.

65. The system of statement 64 or 65, further comprising nucleic acid amplification reagents to amplify the target sequence or the trigger sequence.

66. The system of statement 65, wherein the nucleic acid amplification reagents are isothermal amplification reagents.

67. The system of any one of statements 63 to 66, wherein the Cas12b protein is selected from Table 1 or 2.

68. The system of statement 67, wherein the Cas12b protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

69. A method for detecting one or more sequences in one or more in vitro samples, comprising: contacting one or more samples with: i) a Cas12b effector protein, ii) at least one guide polynucleotide comprising a guide sequence designed to have a degree of complementarity with the one or more target sequences, and designed to form a complex with the Cas12b effector protein; and iii) an oligonucleotide-based masking construct comprising a non-target sequence; and wherein said Cas12 effector protein exhibits collateral nuclease activity and cleaves the non-target sequence of the oligo-nucleotide-based masking construct.

70. The method of statement 69, wherein the Cas12b effector protein is selected from Table 1 or 2.

71. The method of statement 70, wherein the Cas12b effector protein originates from a bacterium selected from the group consisting of: *Alicyclobacillus kakegawensis, Bacillus* sp. V3-13, *Bacillus hisashii, Lentisphaeria bacterium*, and *Laceyella sediminis.*

72. A non-naturally occurring or engineered composition comprising a Cas12b protein linked to an inactive first portion of an enzyme or reporter moiety, wherein the enzyme or reporter moiety is reconstituted when contacted with a complementary portion of the enzyme or reporter moiety.

73. The composition of statement 72, wherein the enzyme or reporter moiety comprises a proteolytic enzyme.

74. The composition of statement 72 or 73, wherein the Cas12 protein comprises a first Cas12b protein and a second Cas12b protein linked to the complementary portion of the enzyme or reporter moiety.

75. The composition of any one of statements 72-74, further comprising: i) a first guide capable of forming a complex with the first Cas12b protein and hybridizing to a first target sequence of a target nucleic acid; and ii) a second guide capable of forming a complex with the second Cas12b protein, and hybridizing to a second target sequence of the target nucleic acid.

76. The composition of any one of statements 72-75, wherein the enzyme comprises a caspase.

77. The composition of any one of statements 72-75, wherein the enzyme comprises tobacco etch virus (TEV).

78. A method of providing a proteolytic activity in a cell containing a target oligonucleotide, comprising: a) contacting a cell or population of cells with: i) a first Cas12b effector protein linked to an inactive portion of a proteolytic enzyme; ii) a second Cas12b effector protein linked to a complementary portion the proteolytic enzyme, wherein proteolytic activity of the proteolytic enzyme is reconstituted when the first portion and the complementary portion of the proteolytic enzyme are contacted; iii) a first guide that binds to the first Cas12b effector protein and hybridizes to a first target sequence of the target oligonucleotide; and iv) a second guide that binds to the second Cas12b effector protein and hybridizes to a second target sequence of the target oligonucleotide, whereby the first portion and a complementary portion of the proteolytic enzyme are contacted and the proteolytic activity of the proteolytic enzyme is reconstituted.

79. The method of statement 78, wherein the proteolytic enzyme is a caspase.

80. The method of statement 79, wherein the proteolytic enzyme is TEV protease, wherein the proteolytic activity of the TEV protease is reconstituted, whereby a TEV substrate is cleaved and activated.

81. The method of statement 80, wherein the TEV substrate is a procaspase engineered to contain TEV target sequences whereby cleavage by the TEV protease activates the procaspase.

82. A method of identifying a cell containing an oligonucleotide of interest, the method comprising contacting the oligonucleotide in the cell with a composition which comprises: i) a first Cas12b effector protein linked to an inactive first portion of a proteolytic enzyme; ii) a second Cas12b effector protein linked to a complementary portion of the proteolytic enzyme wherein activity of the proteolytic enzyme is reconstituted when the first portion and the complementary portion of the proteolytic enzyme are contacted; iii) a first guide that binds to the first Cas12b effector protein and hybridizes to a first target sequence of the oligonucleotide; iv) a second guide that binds to the second Cas12b effector protein and hybridizes to a second target sequence of the oligonucleotide; and v) a reporter which is detectably cleaved, wherein the first portion and a complementary portion of the proteolytic enzyme are contacted when the oligonucleotide of interest is present in the cell, whereby the activity of the proteolytic enzyme is reconstituted and detectably cleaves the reporter.

83. A method of identifying a cell containing an oligonucleotide of interest, the method comprising contacting the oligonucleotide in the cell with a composition which comprises: i) a first Cas12b effector protein linked to an inactive first portion of a reporter; ii) a second Cas12b effector protein linked to a complementary portion of the reporter wherein activity of the reporter is reconstituted when the first portion and the complementary portion of the reporter are contacted; iii) a first guide that binds to the first Cas12b effector protein and hybridizes to a first target sequence of the oligonucleotide; iv) a second guide that binds to the second Cas12b effector protein and hybridizes to a second target sequence of the oligonucleotide; and v) the reporter, wherein the first portion and a complementary portion of the reporter are contacted when the oligonucleotide of interest is present in the cell, whereby the activity of the reporter is reconstituted.

84. The method of statement 82 or 83, wherein the reporter is a fluorescent protein or a luminescent protein.

The invention is further described in the following examples, which do not limit the scope of the invention described in the claims.

EXAMPLES

Example 1

Table 11 shows amino acid sequences of example C2c1 orthologs.

TABLE 11

C2c1 orthologs

| Host | Amino Acid Sequence |
|---|---|
| *Alicyclobacillus macrosporangiidus* strain DSM 17980 (SEQ ID NO: 484) | MVAVKSIKVKLMLGHLPEIREGLWHLHEAVNLGVRYYTEWLAL LRQGNLYRRGKDGAQECYMTAEQCRQELLVRLRDRQKRNGHT GDPGTDEELLGVARRLYELLVPQSVGKKGQAQMLASGFLSPLAD PKSEGGKGTSKSGRKPAWMGMKEAGDSRWVEAKARYEANKAK DPTKQVIASLEMYGLRPLFDVFTETYKTIRWMPLGKHQGVRAWD RDMFQQSLERLMSWESWNERVGAEFARLVDRRDRFREKHFTGQ EHLVALAQRLEQEMKEASPGFESKSSQAHRITKRALRGADGIIDD WLKLSEGEPVDRFDEILRKRQAQNPRRFGSHDLFLKLAEPVFQPL WREDPSFLSRWASYNEVLNKLEDAKQFATFTLPSPCSNPVWARF ENAEGTNIFKYDFLFDHFGKGRHGVRFQRMIVMRDGVPTEVEGI VVPIAPSRQLDALAPNDAASPIDVFVGDPAAPGAFRGQFGGAKIQ YRRSALVRKGRREEKAYLCGFRLPSQRRTGTPADDAGEVFLNLS LRVESQSEQAGRRNPPYAAVFHISDQTRRVIVRYGEIERYLAEHP DTGIPGSRGLTSGLRVMSVDLGLRTSAAISVFRVAHRDELTPDAH GRQPFFFPIHGMDHLVALHERSHLIRLPGETESKKVRSIREQRLDR LNRLRSQMASLRLLVRTGVLDEQKRDRNWERLQSSMERGGERM PSDWWDLFQAQVRYLAQHRDASGEAWGRMVQAAVRTLWRQL AKQVRDWRKEVRRNADKVKIRGIARDVPGGHSLAQLDYLERQY RFLRSWSAFSVQAGQVVRAERDSRFAVALREHIDNGKKDRLKKL ADRILMEALGYVYVTDGRRAGQWQAVYPPCQLVLLEELSEYRFS NDRPPSENSQLMVWSHRGVLEELIHQAQVHDVLVGTIPAAFSSRF DARTGAPGIRCRRVPSIPLKDAPSIPIWLSHYLKQTERDAAALRPG ELIPTGDGEFLVTPAGRGASGVRVVHADINAAHNLQRRLWENFD LSDIRVRCDRREGKDGTVVLIPRLTNQRVKERYSGVIFTSEDGVSF TVGDAKTRRRSSASQGEGDDLSDEEQELLAEADDARERSVVLFR DPSGFVNGGRWTAQRAFWGMVHNRIETLLAERFSVSGAAEKVR G |
| *Bacillus hisashii* strain C4 (SEQ ID NO: 485) | MATRSFILKIEPNEEVKKGLWKTHEVLNHGIAYYMNILKLIRQEAI YEHHEQDPKNPKKVSKAEIQAELWDFVLKMQKCNSFTHEVDKD EVFNILRELYEELVPSSVEKKGEANQLSNKFLYPLVDPNSQSGKG TASSGRKPRWYNLKIAGDPSWEEEKKKWEEDKKKDPLAKILGKL AEYGLIPLFIPYTDSNEPIVKEIKWMEKSRNQSVRRLDKDMFIQAL ERFLSWESWNLKVKEEYEKVEKEYKTLEERIKEDIQALKALEQY EKERQEQLLRDTLNTNEYRLSKRGLRGWREIIQKWLKMDENEPS EKYLEVFKDYQRKHPREAGDYSVYEFLSKKENHFIWRNHPEYPY LYATFCEIDKKKKDAKQQATFTLADPINHPLWVRFEERSGSNLNK YRILTEQLHTEKLKKKLTVQLDRLIYPTESGGWEEKGKVDIVLLP SRQFYNQIFLDIEEKGKHAFTYKDESIKFPLKGTLGGARVQFDRD |

TABLE 11-continued

C2c1 orthologs

| Host | Amino Acid Sequence |
|---|---|
| | HLRRYPHKVESGNVGRIYFNMTVNIEPTESPVSKSLKIHRDDFPK<br>VVNFKPKELTEWIKDSKGKKLKSGIESLEIGLRVMSIDLGQRQAA<br>AASIFEVVDQKPDIEGKLFFPIKGTELYAVHRASFNIKLPGETLVK<br>SREVLRKAREDNLKLMNQKLNFLRNVLHFQQFEDITEREKRVTK<br>WISRQENSDVPLVYQDELIQIRELMYKPYKDWVAFLKQLHKRLE<br>VEIGKEVKHWRKSLSDGRKGLYGISLKNIDEIDRTRKFLLRWSLR<br>PTEPGEVRRLEPGQRFAIDQLNHLNALKEDRLKKMANTIIMHALG<br>YCYDVRKKKWQAKNPACQIILFEDLSNYNPYEERSRFENSKLMK<br>WSRREIPRQVALQGEIYGLQVGEVGAQFSSRFHAKTGSPGIRCSV<br>VTKEKLQDNRFFKNLQREGRLTLDKIAVLKEGDLYPDKGGEKFIS<br>LSKDRKCVTTHADINAAQNLQKRFWTRTHGFYKVYCKAYQVDG<br>QTVYIPESKDQKQKIIEEFGEGYFILKDGVYEWVNAGKLKIKKGS<br>SKQSSSELVDSDILKDSFDLASELKGEKLMLYRDPSGNVFPSDKW<br>MAAGVFFGKLERILISKLTNQYSISTIEDDSSKQSM |
| *Candidatus Lindowbacteria bacterium* RIFCSPLOWO2 (SEQ ID NO: 486) | MPRDDLDLLTNLNSTAKGIRERGKTKEGTDKKKSGRKSSWPMD<br>KAAWETAKTSDSSAHFLEKLKQHPDLKDAFGNLSSGGSKKLEYY<br>KKLAGSAPWKESQSVILEKAARWKEAKQEREEKEQDSSEHGSKA<br>AYRRLFDAGCLPMPEFAKYIDENQIEFGDLKLSDCGAEWKRGM<br>WNQAGQRVRSHMGWQRRREKENAVYSLRKELFEKGGAIRRKKS<br>EELTPEDILPGKAAPDQNDWQERPAYGNQMWFIGLRSYEENEMA<br>KYAEEAGMGSRSAPRIRRGTIKGWSKLRERWLQILKRNPQATRD<br>DLIGELNALRSQDPRAYGDARLFDWLSKTDQRFLWDGFDADGKI<br>LCGRDDRDCVSAFVAYNEEFADEPSSITLTETDERLHPVWPFFGE<br>SSAVPYEIEYDLETACPTAIRLPLLVGKENGGYAERQGTRLPLAE<br>YADLASSFQLPTPVRLDVLVEIREVTRAGRKVTCPFSYFKQNGV<br>WYVREGEIPSGESIQIKQTDRKIENGKIFISSKLRMAYRDDLMVSP<br>ATGDFGSIKILWERIELASHVDQKKLPETAPARSRVFVSFSCNVVE<br>RAPRKQLTRKPDAVVVTIPSGVDQGLVVVSTDVRTGKSKSSSAPP<br>LPPGSRLWPADAVHGDPPLRILSVDLGHRHSAYAVWELGLQQKS<br>WRAGVLKGSTQTPVYADCTGTGLLCLPGDGEDTPAEEESLRLRS<br>RQIRRRLNLQNSILRVSRLLSLDKFEKTIFEQSDVRDRPNKKGLRI<br>RRRCRTEKTPLSEAEVRKNCDKAAEILIRWADTDAMAKSLAATG<br>NADISFWKYMAVKNPPLSAVVDVAPSTIVPDDGPDRETLKKKRQ<br>EEEEKFASSIYENRVKLAGALCSGYDADHRRPATGGLWHDLDRT<br>LIREISYGDRGQKGNPRKLNNEGILRLLRRPPRARPDWREFHRTL<br>NDANRIPKGRTLRGGLSMGRLNFLKEVGDFVKKWSCRPRWPGD<br>RRHIPPGQLFDRQDAEHLEHLRDDRIKRLAHLIVAQALGFEPDIRR<br>GLWKYVDGSTGEILWQHPETRRFFAEGAAGELREVSRPAEIDDD<br>AAARPHTVSAPAHIVVFENLIRYRFQSDRPKTENAGLMQWAHRQ<br>IVHFTKQVASLYGLKVAMVYAAFSSKFCSRCGSPGARVSRFDPA<br>WRNQEWFKRRTSNPRSKVDHSLKRASEDPTADETRPWVLIEGGK<br>EFVCANAKCSAHDEPLNADENAAANIGLRFLRGVEDFRTKVNPA<br>GALKGKLRFETGIHSFRPPVSGSPFWSPMAEPAQKKKIGAAAPGA<br>DVDEAGDADESGVVVLFRDPSGAFRNKQYWYEGKIFWSNVMM<br>AVEAKIAGASVGAKPVAASWGQAQPQSGPGLAKPGGD |
| *Elusimicrobia bacterium* RIFOXYA12 (SEQ ID NO: 487) | MNRIYQGRVTKVEVPDGKDEKGNIKWKKLENWSDILWQHRMLF<br>QDAVNYYTLALAAISGSAVGSDEKSIILREWAVQVQNIWEKAKK<br>KATVFEGPQKRLTSILGLEQNASFDIAAKHILRTSEAKPEQRASAL<br>IRLLEEIDKKNHNVVCGERLPFFCPRNIQSKRSPTSKAVSSVQEQK<br>RQEEVRRFHNMQPEEVVKNAVTLDISLFKSSPKIVFLEDPKKARA<br>ELLKQFDNACKKHKELVGIKKAFTESIDKHGSSLKVPAPGSKPSG<br>LYPSAIVFKYFPVDITKTVFLKATEKLAMGKDREVTNDPIADARV<br>NDKPHFDYFTNIALIREKEKNRAAWFEFDLAAFIEAIMSPHRFYQ<br>DTQKRKEAARKLEEKIKAIEGKGGQFKESDSEDDDVDSLPGFEGD<br>TRIDLLRKLVTDTLGWLGESETPDNNEGKKTEYSISERTLRIFPDIQ<br>KQWSELAEKGETTEGKLLEVLKHEQTEHQSDFGSATLYQHLAKP<br>EFHPIWLKSGTEEWHAENPLKAWLNYKELQYELTDKKRPIHFTP<br>AHPVYSPRYFDFPKKSETEEKEVSKNTHSLTTSLASEHIKNSLQFT<br>AGLIRKTNVGKKAIKARFSYSAPRLRRDCLRSENNENLYKAPWL<br>QPMMRALGIDEEKADRQNFANTRITLMAKGLDDIQLGFPVEANS<br>QELQKEVSNGISWKGQFNWGGIASLSALRWPHEKKPKNPPEQPW<br>WGIDSFSCLAVDLGQRYAGAFARLDVSTIEKKGKSRFIGEACDKK<br>WYAKVSRMGLLRLPGEDVKVWRDASKIDKENGFAFRKELFGEK<br>GRSATPLEAEETAELIKLFGANEKDVMPDNWSKELSFPEQNDKLL<br>IVARRAQAAVSRLHRWAWFFDEAKRSDDAIREILESDDTDLKQK<br>VNKNEIEKVKETIISLLKVKQELLPTLLTRLANRVLPLRGRSWEW<br>KKHHQKNDGFILDQTGKAMPNVLIRGQRGLSMDRIEQITELRKRF<br>QALNQSLRRQIGKKAPAKRDDSIPDCCPDLLEKLDHMKEQRVNQ<br>TAHMILAEALGLKLAEPPKDKKELNETCDMHGAYAKVDNPVSFI<br>VIEDLSRYRSSQGRSPRENSRLMKWCHRAVRDKLKEMCEVFFPL<br>CERRKAGSAWVSLPPLLETPAAYSSRFCSRSGVAGFRAVEVIPGF<br>ELKYPWSWLKDKKDKAGNLAKEALNIRTVSEQLKAFNQDKPEK<br>PRTLLVPIAGGPIFVPISEVGLSSFGLKPQVVQADINAAINLGLRAIS<br>DPRIWEIHPRLRTEKRDGRLFAREKRKYGEEKVEVQPSKNEKAK |

TABLE 11-continued

| C2c1 orthologs | |
|---|---|
| Host | Amino Acid Sequence |
| | KVKDDRKPNYFADFSGKVDWGFGNIKNESGLTLVSGKALWWTI<br>NQLQWERCFDINKRHIEDWSNKQKQ |
| *Omnitrophica* WOR_2 *bacterium* RIFCSPHIGHO 2 (SEQ ID NO: 488) | MNRIYQGRVTKVEKLKNGKSPDDREELKDWQTALWRHHELFQD<br>AVSYYTLALAAMAEGLPDKHPINVLRKRMEEAWEEFPRKTVTPA<br>KNLRDSVRPWLGLSESASFGDALKKILPPAPENKEVRALAVALLA<br>EKARTLKPQKTSASYWGRFCDDLKKKPNWDYSEEELARKTGSG<br>DWVAGLWSEDALNKIDELAKSLKLSSLVKCVPDGQINPEGARNL<br>VKEALDHLEGVSNGTKKEKNDPGPAKKTNNWLRQHASDVRNFI<br>HKNKNQFSSLPNGRLITERARGGGININKTYAGVLFKAFPCPFTFD<br>YVRAAVPEPKVKKVDQEKKSEQSATWTELEKRILRIGDDPIELAR<br>KNNKPIFKAFTALEKWSDQNSKSCWSDFDKCAFEEALKTLNQFN<br>QKTEEREKRRSEAEAELKYMMDENPEWKPKKETEGDDVREVPIL<br>KGDPRYEKLVKLFGDLDEEGSEHATGKIYGPSRASLRGFGKLRNE<br>WVDLFTKANDNPREQDLQKAVTGFQREHKLDMGYTAFFLKLCE<br>RDYWDIWRDDTEVEVKKIREKRWVKSVVYAAADTRELAEELER<br>LQEPVRYTPAEPQFSRRLFMFSDIKGKQGAKHIREGLVEVSLAVK<br>DQSGKYGTCRVRLHYSAPRLIRDHLSDGSSSMWLQPMMAALGL<br>SSDARGCFTRDSKGNVKEPAVALMSDFVGRKRELRMLLNFPVDL<br>DISKLEENIGKKARWEKQMNTAYEKNKLKQRFHLIWPGMELKET<br>QEPGQFWWDNPTIQKEGMYCLAIDLSQRRAADYALLHAGVNRD<br>SKTFVELGQAGGQSWFTKLCAAGSLRLPGEDTEVIREGKRQIELS<br>GKKGRNATQSEYDQAIALAKQLLHNENSAELESAARDWLGDNA<br>KRFSFPEQNDKLIDLYYGALSRYKTWLRWSWRLTEQHKELWDK<br>TLDEIRKVPYFASWGELAGNGTNEATVQQLQKLIADAAVDLRNF<br>LEKALLHIAYRALPLRENTWRWIENGKDGKGKPLHLLVSDGQSP<br>AEIPWLRGQRGLSIARIEQLENFRRAVLSLNRLLRHEIGTKPEFGSS<br>TCGESLPDPCPDLTDKIVRLKEERVNQTAHLIIAQSLGVRLKGHSL<br>FTEEREKADMHGEHEVIPGRSPVDFVVLEDLSRYTTDKSRSRSEN<br>SRLMKWCHRKINEKVKLLAEPFGIPVIEVFASYSSKFDARTGAPG<br>FRAVEVTSEDRPFWRKTIEKQSVAREVFDCLDNLVGKGLNGIHL<br>VLPQNGGPLFIAAVKEDQPLPAIRQADINAAVNIGLRAIAGPSCYH<br>AHPKVRLIKGESGTDKGKWLPRKGKEANKRENAQFGNVDLDLE<br>VKFNRLDIDSDVLKGDNTNLFHDPLNIACYGFATIQNLQHPFLAH<br>ASAVFSRQKGAVARLQWEVCRAINSRRLEAWQKKAEKAAVKR |
| *Phycisphaerae bacterium* ST-NAGAB-D1 (SEQ ID NO: 489) | MATKSYRARILTDSRLAAALDRTHVVFVESLKQMINTYLRMQNG<br>KFGPDHKKLAQIMLSRSNTFAHGVMDQITRDQPTSTLDEEWTDL<br>ARRIHKTTGPLFLQAERFATVKNRAIHTKSRGKVIPSPETLAVPAK<br>FWHQVCDSASAYIRSNRELMQQWRKDRAAWLKDKNEWQQKHP<br>EFMQFYNGPYQNFLKLCDDDRITSQLAAEQQPTASKNNRPRKTG<br>KRFARWHLWYKWLSENPEIIEWRNKASASDFKTVTDDVRKQIIT<br>KYPQQNKYITRLLDWLEDNNPELKTLENLRRTYVKKFDSFKRPPT<br>LTLPSPYRHPYWFTMELDQFYKKADFENGTIQLLLIDEDDDGNW<br>FFNWMPASLKPDPRLVPSWRAETFETEGRFPPYLGGKIGKKLSRP<br>APTDAERKAGIAGAKLMIKNNRSELLFTVFEQDCPPRVKWAKTK<br>NRKCPADNAFSSDGKTRKPLRILSIDLGIRHIGAFALTQGTRNDSA<br>WQTESLKKGIINSPSIPPLRQVRRHDYDLKRKRRRHGKPVKGQRS<br>NANLQAHRTNMAQDRFKKGASAIVSLAREHSADLILFENLHSLK<br>FSAFDERWMNRQLRDMNRRHIVELVSEQAPEFGITVKDDINPWM<br>TSRICSNCNLPGFRFSMKKKNPYREKLPREKCTDFGYPVWEPGGH<br>LFRCPHCDHRVNADINAAANLANKFFGLGYWNNGLKYDAETKT<br>FTVHTDKKTPPLIFKPRPQFDLWADSVKTRKQLGPDPF |
| *Planctomycetes bacterium* RBG_13_46_10 (SEQ ID NO: 490) | MSVRSFQARVECDKQTMEHLWRTHKVFNERLPEIIKILFKMKRG<br>ECGQNDKQKSLYKSISQSILEANAQNADYLLNSVSIKGWKPGTA<br>KKYRNASFTWADDAAKLSSQGIHVYDKKQVLGDLPGMMSQMV<br>CRQSVEAISGHIELTKKWEKEHNEWLKEKEKWESEDEHKKYLDL<br>REKFEQFEQSIGGKITKRRGRWHLYLKWLSDNPDFAAWRGNKA<br>VINPLSEKAQIRINKAKPNKKNSVERDEFFKANPEMKALDNLHGY<br>YERNFVRRRKTKKNPDGFDHKPTFTLPHPTIHPRWFVFNKPKTNP<br>EGYRKLILPKKAGDLGSLEMRLLTGEKNKGNYPDDWISVKFKAD<br>PRLSLIRPVKGRRVVRKGKEQGQTKETDSYEFFDKHLKKWRPAK<br>LSGVKLIFPDKTPKAAYLYFTCDIPDEPLTETAKKIQWLETGDVTK<br>KGKKRKKKVLPHGLVSCAVDLSMRRGTTGFATLCRYENGKIHIL<br>RSRNLWVGYKEGKGCHPYRWTEGPDLGHIAKHKREIRILRSKRG<br>KPVKGEESHIDLQKHIDYMGEDRFKKAARTIVNFALNTENAASK<br>NGFYPRADVLLLENLEGLIPDAEKERGINRALAGWNRRHLVERVI<br>EMAKDAGFKRRVFEIPPYGTSQVCSKCGALGRRYSIIRENNRREIR<br>FGYVEKLFACPNCGYCANADHNASVNLNRRFLIEDSFKSYYDWK<br>RLSEKKQKEEIETIESKLMDKLCAMHKISRGSISK |

TABLE 11-continued

| C2c1 orthologs | |
|---|---|
| Host | Amino Acid Sequence |
| *Spirochaetes bacterium* GWB1_27_13 (SEQ ID NO: 491) | MSFTISYPFKLIIKNKDEAKALLDTHQYMNEGVKYYLEKLLMFR<br>QEKIFIGEDETGKRIYIEETEYKKQIEEFYLIKKTELGRNLTLTLDEF<br>KTLMRELYICLVSSSMENKKGFPNAQQASLNIFSPLFDAESKGYIL<br>KEENNNISLIHKDYGKILLKRLRDNNLIPIFTKFTDIKKITAKLSPTA<br>LDRMIFAQAIEKLLSYESWCKLMIKERFDKEVKIKELENKCENKQ<br>ERDKIFEILEKYEEERQKTFEQDSGFAKKGKFYITGRMLKGFDEIK<br>EKWLKEKDRSEQNLINILNKYQTDNSKLVGDRNLFEFIIKLENQC<br>LWNGDIDYLKIKRDINKNQIWLDRPEMPRFTMPDFKKHPLWYRY<br>EDPSNSNFRNYKIEVVKDENYITIPLITERNNEYFEENYTFNLAKL<br>KKLSENITFIPKSKNKEFEFIDSNDEEEDKKDQKKSKQYIKYCDTA<br>KNTSYGKSGGIRLYFNRNELENYKDGKKMDSYTVFTLSIRDYKS<br>LFAKEKLQPQIFNTVDNKITSLKIQKKFGNEEQTNFLSYFTQNQIT<br>KKDWMDEKTFQNVKELNEGIRVLSVDLGQRFFAAVSCFEIMSEI<br>DNNKLFFNLNDQNHKIIRINDKNYYAKHIYSKTIKLSGEDDDLYK<br>ERKINKNYKLSYQERKNKIGIFTRQINKLNQLLKIIRNDEIDKEKFK<br>ELIETTKRYVKNTYNDGIIDWNNVDNKILSYENKEDVINLHKELD<br>KKLEIDFKEFIRECRKPIFRSGGLSMQRIDFLEKLNKLKRKWVART<br>QKSAESIVLTPKFGYKLKEHINELKDNRVKQGVNYILMTALGYIK<br>DNEIKNDSKKKQKEDWVKKNRACQIILMEKLTEYTFAEDRPREE<br>NSKLRMWSHRQIFNFLQQKASLWGILVGDVFAPYTSKCLSDNNA<br>PGIRCHQVTKKDLIDNSWFLKIVVKDDAFCDLIEINKENVKNKSIK<br>INDILPLRGGELFASIKDGKLHIVQADINASRNIAKRFLSQINPFRV<br>VLKKDKDETFHLKNEPNYLKNYYSILNFVPTNEELTFFKVEENKD<br>IKPTKRIKMDKHEKESTDEGDDYSKNQIALFRDDSGIFFDKSLWV<br>DGKIFWSVVKNKMTKLLRERNNKKNGSK |
| *Verrucomicrobiaceae bacterium* UBA2429 (SEQ ID NO: 492) | MPLSRIYQGRTNSLIILTPTPQEPWDHKALARFDSPLWRHHALFQ<br>DAVNYYQLCLVALASSDGTRPLSKLHEQMKASWDEAKTDTEDS<br>WRVRLARRLGIPAASLFEAALAKVLEGNEAPERARELAGELLLD<br>KIEGDIQQAGRGYWPRFCDPKANPTYDYSATARASASGLTKLAA<br>VIHAENVTEEALKQVAAEMDLSWTVKLQPDKNFVGAEARARLL<br>EAAHHFIKVAESPPTKLAEVLARFPDGLALWQALPEKIAALPEET<br>QVPRNRKASPDLTFATLLFQHFPSLFTAAVLGLSVGKPKSVKAPK<br>VVEKVSARRKANAVTQAVVIEEPEIDFAELGDDPIKLARGERGFV<br>FPAFTSLSFWAVPGPHVPVWKEFDIAAFKEALKTVNQFKLKTSER<br>NALLAEAQRRLDYMDEKTHDWKTGDSDEPGHIPPRLKSDPNFTL<br>IQALTQDEGVSNKATGDQHIPKGVYTGGLRGFYAIKKDWCELWE<br>RKADKSQGTPTEEELISIVTDYQRDHVYDVGDVGLFRALCEPRF<br>WPLWQPLTDEQEAERIKAGRAKDMISAYRVWLELQEDVVRLAQ<br>PIRFTPAHAENSRRLFMFSDISGSHGAEFGSDGKSLEVSIAYDVDG<br>KLQPVRAKLEFSAPRAARDELEGLSGGSESMRWFQPMMKALDC<br>PEVEMPALEKCAVSLMPDVVKKGGGKWVRLLLNFPATLEPEGLI<br>RHIGKQAMWYKQFNGTYKPRTQQLDTGLHLYWPGLEKAPEAED<br>AAAWWNREEIRAKGFSVLSVDLGQRDAGAWALLESRSDKAFSR<br>NRQPFIELGEAGGKLWSTALLGLGMLRLPGEDARTGALDDQGKR<br>AVEFHGKAGRNALEAEWQEAREMALLFGGEEAKSRLGPGFDHL<br>SHSKQNEELLRILSRAQSRLARFHRWSCRIHEKPEATGDDVIDYG<br>QVDELLTKTAEAMLENLKALYTNAGGILDSKSKQPLTLVGLRKK<br>LEAQKVEPEKIAAVLKPHAEIIFQRLGTLIPELKQHLRVSLERLAN<br>RELPLRHREWVWNEAFEKLEQGNFKKEENPKWIRGQRGLSMART<br>EQIENLRKRFMSLRRQMSLIPGEQVKQGVEDKGQRQPEPCEDILN<br>KLDRMKQQRVNQTAHLILAQALGLRLRPHLANDAEREEKDIHGE<br>YELIPGRKPVDFIVMEDLSRYLSSQGRAPSENGRLMKWCHRAVL<br>AKLKQMCEPFGIPVLEVPAAYSSRFCALTGVPGFRAVEVHDGNA<br>EDFRWKRLIKKAEKDKSSKDAEAAAMLFDQLHDLNIEAREARKQ<br>DKKLPLRTLFAPVAGGPLFIPMVGGGPRQADMNAAINLGLRAIAS<br>PTCLRARPKIRAELKDGKHQAMLGNKLEKAAALTLEPPKEPTKE<br>LAAQKRTNFFLDEKFVGKFDTAHVTTSGKKLRLSGGMSLWKAIK<br>DGAWQRVKKINDARIAKWKNNPPPEPDPDDEIQF |
| *Alicyclobacillus kakegawensis* (SEQ ID NO: 493) | MAVKSIKVKLRLSECPDILAGMWQLHRATNAGVRYYTEWVSLM<br>RQEILYSRGPDGGQQCYMTAEDCQRELLRRLRNRQLHNGRQDQP<br>GTDADLLAISRRLYEILVLQSIGKRGDAQQIASSFLSPLVDPNSKG<br>GRGEAKSGRKPAWQKMRDQGDPRWVAAREKYEQRKAVDPSKE<br>ILNSLDALGLRPLFAVFTETYRSGVDWKPLGKSQGVRTWDRDMF<br>QQALERLMSWESWNRRVGEEYARLFQQKMKFEQEHFAEQSHLV<br>KLARALEADMRAASQGFEAKRGTAHQITRRALRGADRVFEIWKS<br>IPEEALFSQYDEVIRQVQAEKRRDFGSHDLFAKLAEPKYQPLWRA<br>DETFLTRYALYNGVLRDLEKARQFATFTLPDACVNPIWTRFESSQ<br>GSNLHKYEFLFDHLGPGRHAVRFQRLLVVESEGAKERDSVVVPV<br>APSGQLDKLVLREEEKSSVALHLHDTARPDGFMAEWAGAKLQY<br>ERSTLARKARRDKQGMRSWRRQPSMLMSAAQMLEDAKQAGDV<br>YLNISVRVKSPSEVRGQRRPPYAALFRIDDKQRRVTVNYNKLSAY<br>LEEHPDKQIPGAPGLLSGLRVMSVDLGLRTSASISVFRVAKKEEV<br>EALGDGRPPHYYPIHGTDDLVAVHERSHLIQMPGETETKQLRKLR |

TABLE 11-continued

C2c1 orthologs

| Host | Amino Acid Sequence |
|---|---|
| | EERQAVLRPLFAQLALLRLLVRCGAADERIRTRSWQRLTKQGRE<br>FTKRLTPSWREALELELTRLEAYCGRVPDDEWSRIVDRTVIALWR<br>RMGKQVRDWRKQVKSGAKVKVKGYQLDVVGGNSLAQIDYLEQ<br>QYKFLRRWSFFARASGLVVRADRESHFAVALRQHIENAKRDRLK<br>KLADRILMEALGYVYEASGPREGQWTAQHPPCQLIILEELSAYRF<br>SDDRPPSENSKLMAWGHRGILEELVNQAQVHDVLVGTVYAAFSS<br>RFDARTGAPGVRCRRVPARFVGATVDDSLPLWLTEFLDKHRLDK<br>NLLRPDDVIPTGEGEFLVSPCGEEAARVRQVHADINAAQNLQRRL<br>WQNFDITELRLRCDVKMGGEGTVLVPRVNNARAKQLFGKKVLV<br>SQDGVTFFERSQTGGKPHSEKQTDLTDKELELIAEADEARAKSVV<br>LFRDPSGHIGKGHWIRQREFWSLVKQRIESHTAERIRVRGVGSSL<br>D |
| *Bacillus* sp._V3-13<br>(SEQ ID NO: 494) | MAIRSIKLKMKTNSGTDSIYLRKALWRTHQLINEGIAYYMNLLTL<br>YRQEAIGDKTKEAYQAELINIIRNQQRNNGSSEEHGSDQEILALLR<br>QLYELIIPSSIGESGDANQLGNKFLYPLVDPNSQSGKGTSNAGRKP<br>RWKRLKEEGNPDWELEKKKDEERKAKDPTVKIFDNLNKYGLLP<br>LFPLFTNIQKDIEWLPLGKRQSVRKWDKDMFIQAIERLLSWESWN<br>RRVADEYKQLKEKTESYYKEHLTGGEEWIEKIRKFEKERNMELE<br>KNAFAPNDGYFITSRQIRGWDRVYEKWSKLPESASPEELWKVVA<br>EQQNKMSEGFGDPKVFSFLANRENRDIWRGHSERIYHIAAYNGL<br>QKKLSRTKEQATFTLPDAIEHPLWIRYESPGGTNLNLFKLEEKQK<br>KNYYVTLSKIIWPSEEKWIEKENIEIPLAPSIQFNRQIKLKQHVKGK<br>QEISFSDYSSRISLDGVLGGSRIQFNRKYIKNHKELLGEGDIGPVFF<br>NLVVDVAPLQETRNGRLQSPIGKALKVISSDFSKVIDYKPKELMD<br>WMNTGSASNSFGVASLLEGMRVMSIDMGQRTSASVSIFEVVKEL<br>PKDQEQKLFYSINDTELFAIHKRSFLLNLPGEVVTKNNKQQRQER<br>RKKRQFVRSQIRMLANVLRLETKKTPDERKKAIHKLMEIVQSYDS<br>WTASQKEVWEKELNLLTNMAAFNDEIWKESLVELHHRIEPYVG<br>QIVSKWRKGLSEGRKNLAGISMWNIDELEDTRRLLISWSKRSRTP<br>GEANRIETDEPFGSSLLQHIQNVKDDRLKQMANLIIMTALGFKYD<br>KEEKDRYKRWKETYPACQIILFENLNRYLFNLDRSRRENSRLMK<br>WAHRSIPRTVSMQGEMFGLQVGDVRSEYSSRFHAKTGAPGIRCH<br>ALTEEDLKAGSNTLKRLIEDGFINESELAYLKKGDIIPSQGGELFV<br>TLSKRYKKDSDNNELTVIHADINAAQNLQKRFWQQNSEVYRVPC<br>QLARMGEDKLYIPKSQTETIKKYFGKGSFVKNNTEQEVYKWEKS<br>EKMKIKTDTTFDLQDLDGFEDISKTIELAQEQQKKYLTMFRDPSG<br>YFFNNETWRPQKEYWSIVNNIIKSCLKKKILSNKVEL |
| *Desulfatirhabdium butyrativorans*<br>(SEQ ID NO: 495) | MPLSNNPPVTQRAYTLRLRGADPSDLSWREALWHTHEAVNKGA<br>KVFGDWLLTLRGGLDHTLADTKVKGGKGKPDRDPTPEERKARRI<br>LLALSWLSVESKLGAPSSYIVASGDEPAKDRNDNVVSALEEILQS<br>RKVAKSEIDDWKRDCSASLSAAIRDDAVWVNRSKVFDEAVKSV<br>GSSLTREEAWDMLERFFGSRDAYLTPMKDPEDKSSETEQEDKAK<br>DLVQKAGQWLSSRYGTSEGADFCRMSDIYGKIAAWADNASQGG<br>SSTVDDLVSELRQHFDTKESKATNGLDWIIGLSSYTGHTPNPVHE<br>LLRQNTSLNKSHLDDLKKKANTRAESCKSKIGSKGQRPYSDAILN<br>DVESVCGFTYRVDKDGQPVSVADYSKYDVDYKWGTARHYIFAV<br>MLDHAARRISLAHKWIKRAEAERHKFEEDAKRIANVPARAREWL<br>DSFCKERSVTSGAVEPYRIRRRAVDGWKEVVAAWSKSDCKSTED<br>RIAAARALQDDSEIDKFGDIQLFEALAEDDALCVWHKDGEATNE<br>PDFQPLIDYSLAIEAEFKKRQFKVPAYRHPDELLHPVFCDFGKSR<br>WKINYDVHKNVQAPFYRGLCLTLWTGSEIKPVPLCWQSKRLTRD<br>LALGNNHRNDAASAVTRADRLGRAASNVTKSDMVNITGLFEQA<br>DWNGRLQAPRQQLEAIAVVRDNPRLSEQERNLRMCGMIEHIRWL<br>VTFSVKLQPQGPWCAYAEQHGLNTNPQYWPHADTNRDRKVHA<br>RLILPRLPGLRVLSVDLGHRYAAACAVWEAVNTETVKEACQNV<br>GRDMPKEHDLYLHIKVKKQGIGKQTEVDKTTIYRRIGADTLPDG<br>RPHPAPWARLDRQFLIKLQGEEKDAREASNEEIWALHQMECKLD<br>RTKPLIDRLIASGWGLLKRQMARLDALKELGWIPAPDSSENLSRE<br>DGEAKDYRESLAVDDLMFSAVRTLRLALQRHGNRARIAYYLISE<br>VKIRPGGIQEKLDENGRIDLLQDALALWHELFSSPGWRDEAAKQ<br>LWDSRIATLAGYKAPEENGDNVSDVAYRKKQQVYREQLRNVAK<br>TLSGDVITCKELSDAWKERWEDEDQRWKKLLRWFKDWVLPSGT<br>QANNATIRNVGGLSLSRLATITEFRRKVQVGFFTRLRPDGTRHEIG<br>EQFGQKTLDALELLREQRVKQLASRIAEAALGIGSEGGKGWDGG<br>KRPRQRINDSRFAPCHAVVIENLANYRPDETRTRLENRRLMTWS<br>ASKVHKYLSEACQLNGLYLCTVSAWYTSRQDSRTGAPGIRCQDV<br>SVREFMQSPFWRKQVKQAEAKHDENKGDARERFLCELNKTWKA<br>KTPAEWKKAGFVRIPLRGGEIFVSADSKSPSAKGIHADLNAAANI<br>GLRALTDPDWPGKWWYVPCDPVSFESKMDYVKGCAAVKVGQP<br>LRQPAQTNADGAASKIRKGKKNRTAGTSKEKVYLWRDISAFPLE<br>SNEIGEWKETSAYQNDVQYRVIRMLKEHIKSLDNRTGDNVEG |

TABLE 11-continued

C2c1 orthologs

| Host | Amino Acid Sequence |
|---|---|
| *Desulfonatronum thiodismutans* (SEQ ID NO: 496) | MVLGRKDDTAELRRALWTTHEHVNLAVAEVERVLLRCRGRSY<br>WTLDRRGDPVHVPESQVAEDALAMAREAQRRNGWPVVGEDEEI<br>LLALRYLYEQIVPSCLLDDLGKPLKGDAQKIGTNYAGPLFDSDTC<br>RRDEGKDVACCGPFHEVAGKYLGALPEWATPISKQEFDGKDASH<br>LRFKATGGDDAFFRVSIEKANAWYEDPANQDALKNKAYNKDD<br>WKKEKDKGISSWAVKYIQKQLQLGQDPRTEVRRKLWLELGLLPL<br>FIPVFDKTMVGNLWNRLAVRLALAHLLSWESWNHRAVQDQALA<br>RAKRDELAALFLGMEDGFAGLREYELRRNESIKQHAFEPVDRPY<br>VVSGRALRSWTRVREEWLRHGDTQESRKNICNRLQDRLRGKFG<br>DPDVFHWLAEDGQEALWKERDCVTSFSLLNDADGLLEKRKGYA<br>LMTFADARLHPRWAMYEAPGGSNLRTYQIRKTENGLWADVVLL<br>SPRNESAAVEEKTFNVRLAPSGQLSNVSFDQIQKGSKMVGRCRY<br>QSANQQFEGLLGGAEILFDRKRIANEQHGATDLASKPGHVWFKL<br>TLDVRPQAPQGWLDGKGRPALPPEAKHFKTALSNKSKFADQVRP<br>GLRVLSVDLGVRSFAACSVFELVRGGPDQGTYFPAADGRTVDDP<br>EKLWAKHERSFKITLPGENPSRKEEIARRAAMEELRSLNGDIRRL<br>KAILRLSVLQEDDPRTEHLRLFMEAIVDDPAKSALNAELFKGFGD<br>DRFRSTPDLWKQHCHFFHDKAEKVVAERFSRWRTETRPKSSSWQ<br>DWRERRGYAGGKSYWAVTYLEAVRGLILRWNMRGRTYGEVNR<br>QDKKQFGTVASALLHHINQLKEDRIKTGADMIIQAARGFVPRKN<br>GAGWVQVHEPCRLILFEDLARYRFRTDRSRRENSRLMRWSHREI<br>VNEVGMQGELYGLHVDTTEAGFSSRYLASSGAPGVRCRHLVEED<br>FHDGLPGMHLVGELDWLLPKDKDRTANEARRLLGGMVRPGML<br>VPWDGGELFATLNAASQLHVIHADINAAQNLQRRFWGRCGEAIR<br>IVCNQLSVDGSTRYEMAKAPKARLLGALQQLKNGDAPFHLTSIP<br>NSQKPENSYVMTPTNAGKKYRAGPGEKSSGEEDELALDIVEQAE<br>ELAQGRKTFFRDPSGVFFAPDRWLPSEIYWSRIRRRIWQVTLERN<br>SSGRQERAEMDEMPY |
| *Lentisphaeria bacterium* (SEQ ID NO: 497) | MAVELNRIYQGRVNHVYIFDENQNQVSVDNGDDLLFVHHELYQ<br>DAINYYLVALAAMALDSKDSLFGKFKMQIRAVWNDFYRNGQLR<br>PGLKHSLIRSLGHAAELNTSNGADIAMNLILEDGGIPSEILNAALE<br>HLAEKCTGDVSQLGKTFFPRFCDTAYHGNWDVDAKSFSEKKGR<br>QRLVDALYSLHPVQAVQELAPEIEIGWGGVKTQTGKFFTGDEAK<br>ASLKKAISYFLQDTGKNSPELQEYFSVAGKQPLEQYLGKIDTFPEI<br>SFGRISSHQNINISNAMWILKFFPDQYSVDLIKNLIPNKKYEIGIAP<br>QWGDDPVKLSRGKRGYTFRAFTDLAMWEKNWKVFDRAAFSDA<br>LKTINQFRNKTQERNDQLKRYCAALNWMDGESSDKKPPVEPAD<br>ADAVDEAATSVLPILAGDKRWNALLQLQKELGICNDFTENELMD<br>YGLSLRTIRGYQKLRSMMLEKEEKMRAKTADDEEISQALQEIIIKF<br>QSSHRDTIGSVSLFLKLAEPKYFCVWHDADKNQNFASVDMVAD<br>AVRYYSYQEEKARLEEPIQITPADARYSRRVSDLYALVYKNAKE<br>CKTGYGLRPDGNFVFEIAQKNAKGYAPAKVVLAFSAPRLKRDGL<br>IDKEFSAYYPPVLQAFLREEEAPKQSFKTTAVILMPDWDKNGKRR<br>ILLNFPIKLDVSAIHQKTDHRFENQFYFANNTNTCLLWPSYQYKK<br>PVTWYQGKKPFDVVAVDLGQRSAGAVSRITVSTEKREHSVAIGE<br>AGGTQWYAYRKFSGLLRLPGEDATVIRDGQRTEELSGNAGRLST<br>EEETVQACVLCKMLIGDATLLGGSDEKTIRSFPKQNDKLLIAFRR<br>ATGRMKQLQRWLWMLNENGLCDKAKTEISNSDWLVNKNIDNV<br>LKEEKQHREMLPAILLQIADRVLPLRGRKWDWVLNPQSNSFVLQ<br>QTAHGSGDPHKKICGQRGLSFARIEQLESLRMRCQALNRILMRKT<br>GEKPATLAEMRNNPIPDCCPDILMRLDAMKEQRINQTANLILAQA<br>LGLRHCLHSESATKRKENGMHGEYEKIPGVEPAAFVVLEDLSRY<br>RFSQDRSSYENSRLMKWSHRKILEKLALLCEVFNVPILQVGAAYS<br>SKFSANAIPGFRAEECSIDQLSFYPWRELKDSREKALVEQIRKIGH<br>RLLTFDAKATIIMPRNGGPVFIPFVPSDSKDTLIQADINASFNIGLR<br>GVADATNLLCNNRVSCDRKKDCWQVKRSSNFSKMVYPEKLSLS<br>FDPIKKQEGAGGNFFVLGCSERILTGTSEKSPVFTSSEMAKKYPNL<br>MFGSALWRNEILKLERCCKINQSRLDKFIAKKEVQNEL |
| *Laceyella sediminis* (SEQ ID NO: 498) | MSIRSFKLKIKTKSGVNAEELRRGLWRTHQLINDGIAYYMNAVLV<br>LLRQEDLFIRNEETNEIEKRSKEEIQGELLERVHKQQQRNQWSGE<br>VDDQTLLQTLRHLYEEIVPSVIGKSGNASLKARFFLGPLVDPNNK<br>TTKDVSKSGPTPKWKKMKDAGDPNWVQEYEKYMAERQTLVRL<br>EEMGLIPLFPMYTDEVGDIHWLPQASGYTRTWDRDMFQQAIERL<br>LSWESWNRRVRERRAQFEKKTHDFASRFSESDVQWMNKLREYE<br>AQQEKSLEENAFAPNEPYALTKKALRGWERVYHSWMRLDSAAS<br>EEAYWQEVATCQTAMRGEFGDPAIYQFLAQKENHDIWRGYPER<br>VIDFAELNHLQRELRRAKEDATFTLPDSVDHPLWVRYEAPGGTNI<br>HGYDLVQDTKRNLTLILDKFILPDENGSWHEVKKVPFSLAKSKQF<br>HRQVWLQEEQKQKKREVVFYDYSTNLPHLGTLAGAKLQWDRN<br>FLNKRTQQQIEETGEIGKVFFNISVDVRPAVEVKNGRLQNGLGKA<br>LTVLTHPDGTKIVTGWKAEQLEKWVGESGRVSSLGLDSLSEGLR<br>VMSIDLGQRTSATVSVFEITKEAPDNPYKFFYQLEGTELFAVHQR<br>SFLLALPGENPPQKIKQMREIRWKERNRIKQQVDQLSAILRLHKK |

TABLE 11-continued

| C2c1 orthologs | |
|---|---|
| Host | Amino Acid Sequence |
| | VNEDERIQAIDKLLQKVASWQLNEEIATAWNQALSQLYSKAKEN DLQWNQAIKNAHHQLEPVVGKQISLWRKDLSTGRQGIAGLSLWS IEELEATKKLLTRWSKRSREPGVVKRIERFETFAKQIQHHINQVKE NRLKQLANLIVMTALGYKYDQEQKKWIEVYPACQVVLFENLRS YRFSYERSRRENKKLMEWSHRSIPKLVQMQGELFGLQVADVYA AYSSRYHGRTGAPGIRCHALTEADLRNETNIIHELIEAGFIKEEHRP YLQQGDLVPWSGGELFATLQKPYDNPRILTLHADINAAQNIQKRF WHPSMWFRVNCESVMEGEIVTYVPKNKTVHKKQGKTFRFVKVE GSDVYEWAKWSKNRNKNTFSSITERKPPSSMILFRDPSGTFFKEQ EWVEQKTFWGKVQSMIQAYMKKTIVQRMEE |
| *Methylobacterium nodulans* (long form) (SEQ ID NO: 499) | MYEAIVLADDANAQLANAFLGPLTDPNSAGFLEAFNKVDRPAPS WLDQVPASDPIDPAVLAEANAWLDTDAGRAWLVDTGAPPRWRS LAAKQDPIWPREFARKLGELRKEAASGTSAIIKALKRDFGVLPLF QPSLAPRILGSRSSLTPWDRLAFRLAVGHLLSWESWCTRARDEHT ARVQRLEQFSSAHLKGDLATKVSTLREYERARKEQIAQLGLPMG ERDFLITVRMTRGWDDLREKWRRSGDKGQEALHAIIATEQTRKR GRFGDPDLFRWLARPENHHVWADGHADAVGVLARVNAMERLV ERSRDTALMTLPDPVAHPRSAQWEAEGGSNLRNYQLEAVGGEL QITLPLLKAADDGRCIDTPLSFSLAPSDQLQGVVLTKQDKQQKIT YCTNMNEVFEAKLGSADLLLNWDHLRGRIRDRVDAGDIGSAFLK LALDVAHVLPDGVDDQLARAAFHFQSAKGAKSKHADSVQAGLR VLSIDLGVRSFATCSVFELKDTAPTTGVAFPLAEFRLWAVHERSF TLELPGENVGAAGQQWRAQADAELRQLRGGLNRHRQLLRAATV QKGERDAYLTDLREAWSAKELWPFEASLLSELERCSTVADPLWQ DTCKRAARLYRTEFGAVVSEWRSRTRSREDRKYAGKSMWSVQH LTDVRRFLQSWSLAGRASGDIRRLDRERGGVFAKDLLDHIDALK DDRLKTGADLIVQAARGFQRNEFGYWVQKHAPCHVILFEDLSRY RMRTDRPRRENSQLMQWAHRGVPDMVGMQGEIYGIQDRRDPDS ARKHARQPLAAFCLDTPAAFSSRYHASTMTPGIRCHPLRKREFED QGFLELLKRENEGLDLNGYKPGDLVPLPGGEVFVCLNANGLSRIH ADINAAQNLQRRFWTQHGDAFRLPCGKSAVQGQIRWAPLSMGK RQAGALGGFGYLEPTGEDSGSCQWRKTTEAEWRRLSGAQKDRD EAAAAEDEELQGLEEELLERSGERVVFFRDPSGVVLPTDLWFPSA AFWSIVRAKTVGRLRSHLDAQAEASYAVAAGL |
| *Opitutaceae bacterium* (SEQ ID NO: 500) | MSLNRIYQGRVAAVETGTALAKGNVEWMPAAGGDEVLWQHHE LFQAAINYYLVALLALADKNNPVLGPLISQMDNPQSPYHVWGSF RRQGRQRTGLSQAVAPYITPGNNAPTLDEVFRSILAGNPTDRATL DAALMQLLKACDGAGAIQQEGRSYWPKFCDPDSTANFAGDPAM LRREQHRLLLPQVLHDPAITHDSPALGSFDTYSIATPDTRTPQLTG PKARARLEQAITLWRVRLPESAADFDRLASSLKKIPDDDSRLNLQ GYVGSSAKGEVQARLFALLLFRHLERSSFTLGLLRSATPPPKNAE TPPPAGVPLPAASAADPVRIARGKRSFVFRAFTSLPCWHGGDNIH PTWKSFDIAAFKYALTVINQIEEKTKERQKECAELETDFDYMHGR LAKIPVKYTTGEAEPPPILANDLRIPLLRELLQNIKVDTALTDGEA VSYGLQRRTIRGFRELRRIWRGHAPAGTVFSSELKEKLAGELRQF QTDNSTTIGSVQLFNELIQNPKYWPIWQAPDVETARQWADAGFA DDPLAALVQEAELQEDIDALKAPVKLTPADPEYSRRQYDFNAVS KFGAGSRSANRHEPGQTERGHNTFTTEIAARNAADGNRWRATH VRIHYSAPRLLRDGLRRPDTDGNEALEAVPWLQPMMEALAPLPT LPQDLTGMPVFLMPDVTLSGERRILLNLPVTLEPAALVEQLGNAG RWQNQFFGSREDPFALRWPADGAVKTAKGKTHIPWHQDRDHFT VLGVDLGTRDAGALALLNVTAQKPAKPVHRIIGEADGRTWYASL ADARMIRLPGEDARLFVRGKLVQEPYGERGRNASLLEWEDARNI ILRLGQNPDELLGADPRRHSYPEINDKLLVALRRAQARLARLQNR SWRLRDLAESDKALDEIHAERAGEKPSPLPPLARDDAIKSTDEAL LSQRDIIRRSFVQIANLILPLRGRRWEWRPHVEVPDCHILAQSDPG TDDTKRLVAGQRGISHERIEQIEELRRRCQSLNRALRHKPGERPVL GRPAKGEEIADPCPALLEKINRLRDQRVDQTAHAILAAALGVRLR APSKDRAERRHRDIHGEYERFRAPADFVVIENLSRYLSSQDRARS ENTRLMQWCHRQIVQKLRQLCETYGIPVLAVPAAYSSRFSSRDGS AGFRAVHLTPDHRHRMPWSRILARLKAHEEDGKRLEKTVLDEAR AVRGLFDRLDRFNAGHVPGKPWRTLLAPLPGGPVFVPLGDATPM QADLNAAINIALRGIAAPDRHDIHHRLRAENKKRILSLRLGTQRE KARWPGGAPAVTLSTPNNGASPEDSDALPERVSNLFVDIAGVAN FERVTIEGVSQKFATGRGLWASVKQRAWNRVARLNETVTDNNR NEEEDDIPM |

TABLE 12

| Tracrs and direct repeats Phycisphaerae bacterium ST-NAGAB-D1 | |
|---|---|
| tracer region | CAACATGCTCGCTTTGCGAAGGCTGACGGCCCGCT CTCATTTGGCATTGCCGGGAGCCGGAGTTTTCGGA AGAGAGTGTCGACGACTGCTGATCTCCGCATCCGC GTCCTGTTCGCCAGGCCGGGTCGGGTGTACGGATC ATGCTGGCAGCAGTCTACGCCG (SEQ ID NO: 501) |
| putative mature tracr 1 | CGGAAGAGAGUGUCGACGACUGCUGAUCUCCGCAU CCGCGUCCUGUUCGCCAGGCCGGGU (SEQ ID NO: 502) |
| putative mature tracr 2 | CCAACAUGCUCGCUUUGCGAAGGCUGACGGCCCGC UCUCAUUUGGCAUUGCCGGGAGCCGGA (SEQ ID NO: 503) |
| putative mature tracr 3 | UCGCUUUGCGAAGGCUGACGGCCCGCUCUCAUUUG GCAUUGCCGGGAGCCGGAGUUUUCGGAAGAGAGUG UCGACGACUGCUGAUCUCCGCAUCCGCGUCCUGUU CGCCAGGCCGGGU (SEQ ID NO: 504) |
| putative mature tracr 4 | AUGCUCGCUUUGCGAAGGCUGACGGCCCGCUCUCA UUUGGCAUUGCCGGGAGCCGGAGUUUUCGGAAGAG AGUGUCGACGACUGCUG (SEQ ID NO: 505) |
| putative mature tracr 5 | AGUUUUCGGAAGAGAGUGUCGACGACUGCUGAUCU CCGCAUCCGCGUCCUGUUCGCCAGGCCGGGUCGGG U (SEQ ID NO: 506) |
| putative mature tracr 6 | CGCCUAUCAGCCAACAUGCUCGCUUUGCGAAGGCU GACGGCCCGCUCUCAUUUGGCAUUGC (SEQ ID NO: 507) |
| putative mature tracr 7 | CGCCUAUCAGCCAACAUGCUCGCUUUGCGAAGGCU GACGGCCCGCUCUCAUUUGGCAUUGCCGGGAGCCG GAGUUUUCGGAAGAGAG (SEQ ID NO: 508) |
| putative mature tracr 8 | UGAUCUCCGCAUCCGCGUCCUGUUCGCCAGGCCGG GUCGGGUGUACGGAUCAUGCUGGCAGCAGUCUACG CCGAGAACAUUCGC (SEQ ID NO: 509) |
| putative mature tracr 9 | UGAUCUCCGCAUCCGCGUCCUGUUCGCCAGGCCGG GUCGGGUGUACGGAUCAUGCUGGCAGCAGUCUACG CCGAGAACAUUCGC (SEQ ID NO: 510) |
| putative mature tracr 10 | UCCGCAUCCGCGUCCUGUUCGCCAGGCCGGGUCGG GUGUACGGAUCAUGCUGGCAGCAGUCUACGCCGAG AACAUUCGCUUUU (SEQ ID NO: 511) |
| direct repeat | GGCGCAACCCGCACACAACCGCGAATGGACAC (SEQ ID NO: 512) |
| mature direct repeat | CCGCGAATGGACAC (SEQ ID NO: 513) |

Table 13 shows additional example Cas12b orthologs.

TABLE 13

| C2c1 orthologs | |
|---|---|
| Host | GenBank Identifier (GI) number |
| *Alicyclobacillus acidoterrestris* | 544884152 |
| *Alicyclobacillus contaminans* | 652589596 |
| *Desulfovibrio inopinatus* | 652932497 |
| *Desulfonatronum thiodismutans* | 667765471 |

TABLE 13-continued

| C2c1 orthologs | |
|---|---|
| Host | GenBank Identifier (GI) number |
| *Opitutaceae bacterium* TAV5 | 497199019 |
| *Tuberibacillus calidus* | 654153037 |
| *Bacillus thermoamylovorans* | 754485389 |
| *Brevibacillus* sp. CF 112 | 495056180 |
| *Bacillus* sp. NSP2-1 | 651512544 |
| *Desulfatirhabdium butyrativorans* | 654874074 |
| *Alicyclobacillus herbarius* | 652569729 |
| Alicyclobacillus *contaminans* | 652589403 |
| *Citrobacter freundii* ATCC 8090 | 411770298 |
| *Citrobacter freundii* | 696372964 |
| *Brevi bacillus agri* | 492410745 |
| *Brevi bacillus agri* | 492410748 |
| *Brevibacillus* sp. CF 112 | 495062547 |
| *Methylobacterium nodulans* | 506407588 |
| *Methylobacterium nodulans* ORS 2060 | 219945206 |
| *Methylobacterium nodulans* | 760065057 |

Example 2—Choice and Designs of Adenosine Deaminases

A number of ADs are used, and each will have varying levels of activity. These ADs include:

1. Human ADARs (hADAR1, hADAR2, hADAR3)
2. Squid *Loligo pealeii* ADARs (sqADAR2a, sqADAR2b)
3. ADATs (human ADAT, *Drosophila* ADAT)

Mutations can also be used to increase the activity of ADAR reacting against a DNA-RNA heteroduplex. For example, for the human ADAR genes, the hADAR1d (E1008Q) or hADAR2d(E488Q) mutation is used to increase their activity against a DNA-RNA target.

Each ADAR has varying levels of sequence context requirement. For example, for hADAR1d (E1008Q), tAg and aAg sites are efficiently deaminated, whereas aAt and cAc are less efficiently edited, and gAa and gAc are even less edited. However, the context requirement will vary for different ADARs.

Figure 3A:
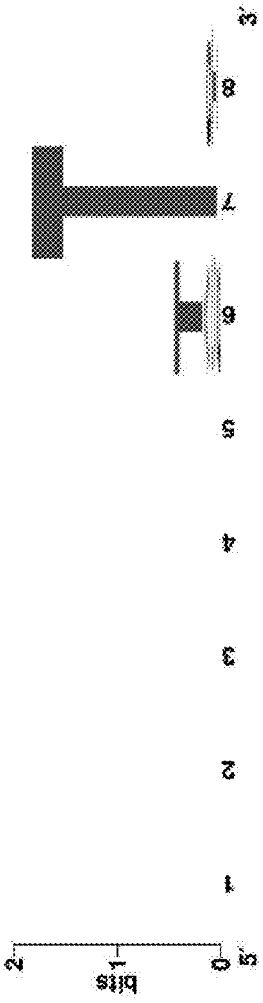
FIG. 3A shows results of a PAM screen for Seqlogos provided for the most relaxed predicted PAM and FIG. 3B shows the most stringent predicted PAM.
Figure 3B:
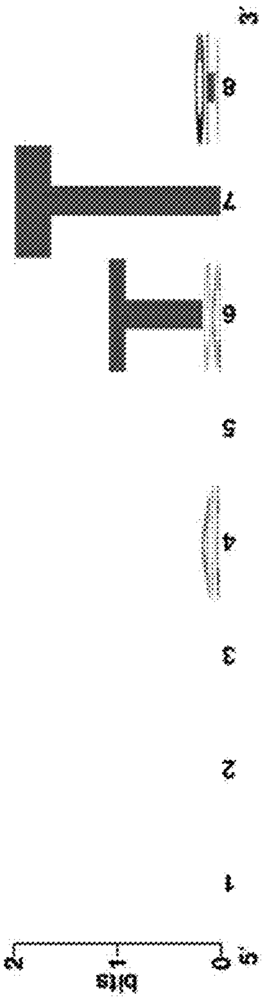
Figure 4:
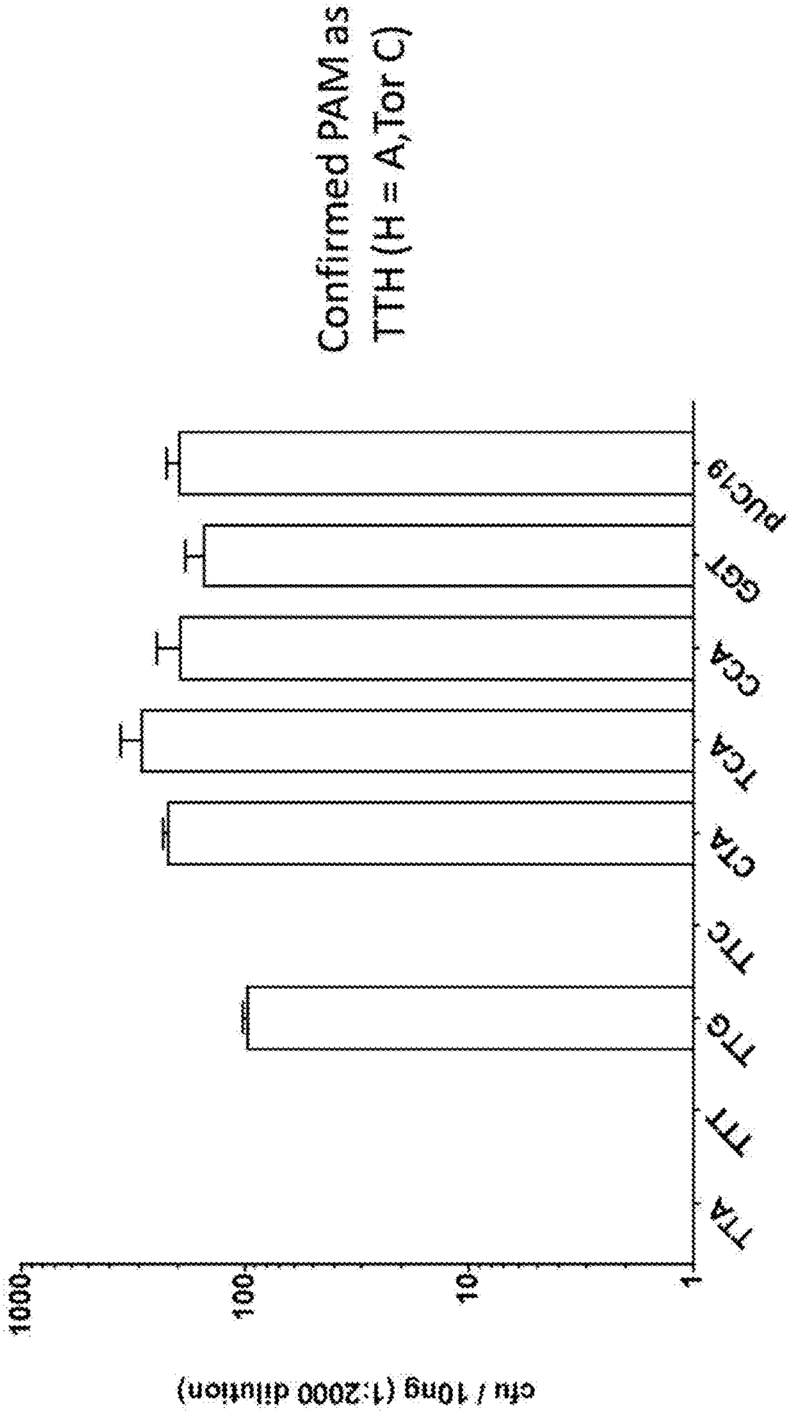
FIG. 4 shows in vivo confirmation of the PhbC2c1 PAM as TTH (H=A, T or C). Cells were transformed with plasmid DNA encoding different PAM sequences located 5' of a recognizable protospacer.

A schematic showing of one version of the system is provided in FIG. 1. The amino acid sequences of example Cpf1-AD fusion proteins are provided in FIGS. 2 to 4.

Example 3—Characterization of C2c1 (Cas12b) from Phycisphaerae Bacterium ST-NAGAB-D1

*E. coli* (Stbl3) were transformed with a low copy plasmid (pACYC184) containing parts of the endogenous genomic sequence of the Phycisphaerae bacterium CRISPR-C2c1 locus. Whole RNA was extracted form cells cultured for 14 h and RNA was prepped for and analyzed by small RNA sequencing. The methods were as described by Zetsche et al. 2015.

Figure 2A:
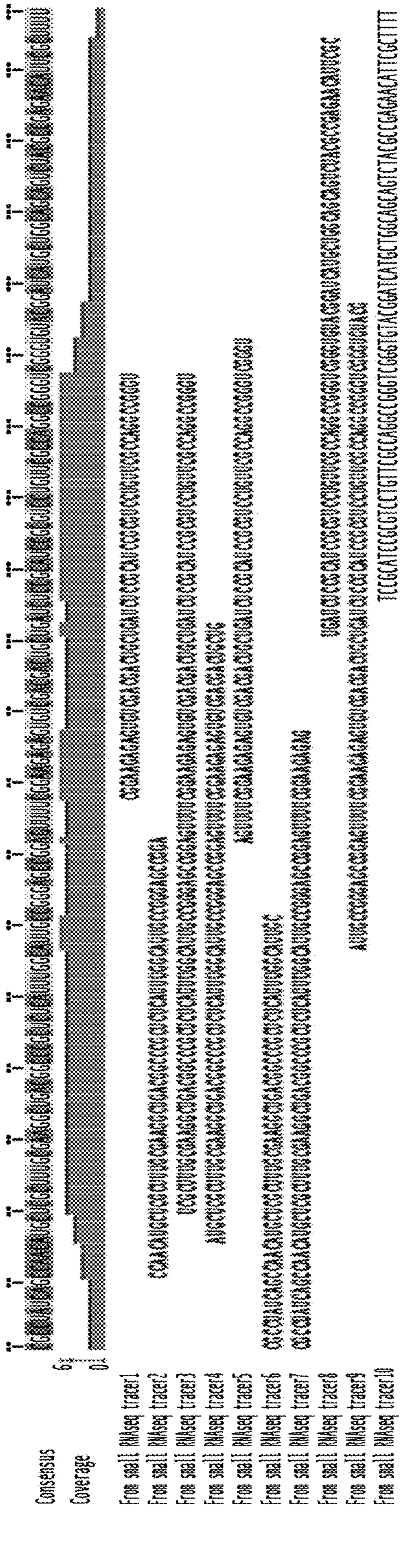
FIGS. 2A-2C show predicted tracrRNAs (FIG. 2A) (SEQ ID NO:1-11) and fold prediction of duplexes of tracers (light gray) with direct repeat (dark gray) for Tracer #1 (FIG. 2B) and Tracer #5 (FIG. 2C) (SEQ ID NO:12, 656, and 13).
Figure 2B:
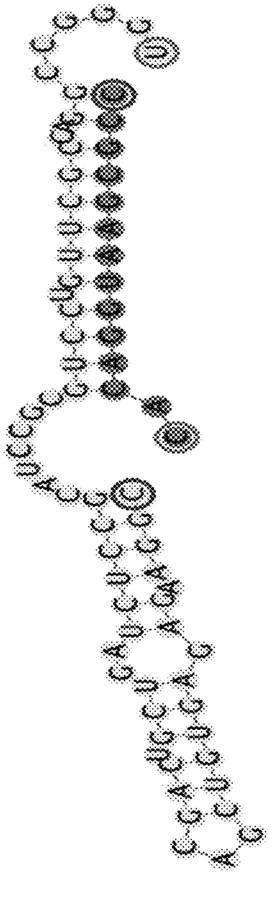
Figure 2C:
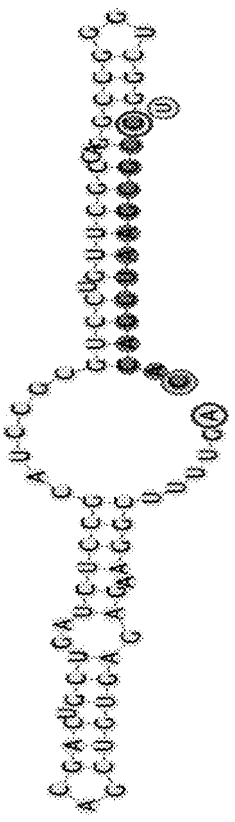

Small RNAseq revealed the location of the tracer RNA and the architecture of the mature crRNAs. Mature crRNA are most likely 14 nt of the direct repeat followed by 20-24nt of guide sequence. Potential tracr sequences with high read numbers are shown in FIG. 2 and sequences shown in Table 12. Structures of tracrRNA duplexes with direct repeats (DR) based on RNA fold prediction are depicted in FIG. 2.

PAM screening was performed as in Zetsche et al., 2015. In particular, Stbl3 *E. coli* were transformed with 10 ng plasmid DNA encoding different PAM sequences located 5' of a recognizable protospacer, and colony counts performed. Reduced colony formation was confirmed for TTH PAMs (H=A, T, C).

Example 4—Colorimetric Detection

Figure 6:
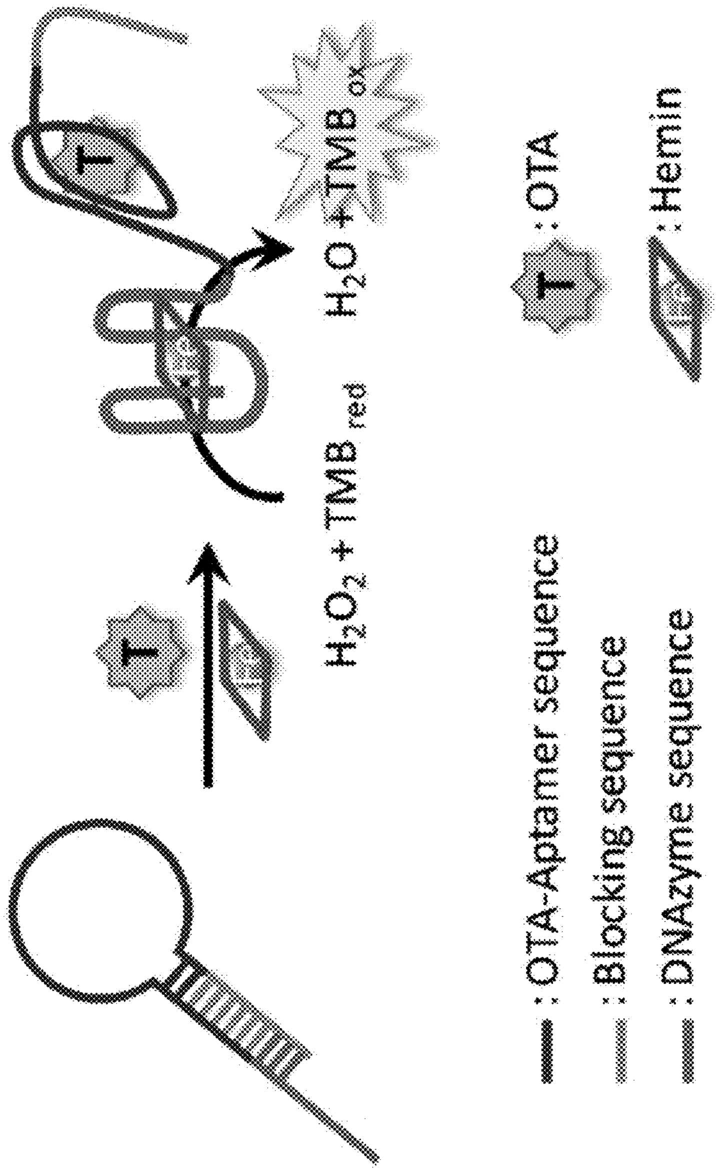
FIG. 6 illustrates aptamer color generation.
Figure 7:
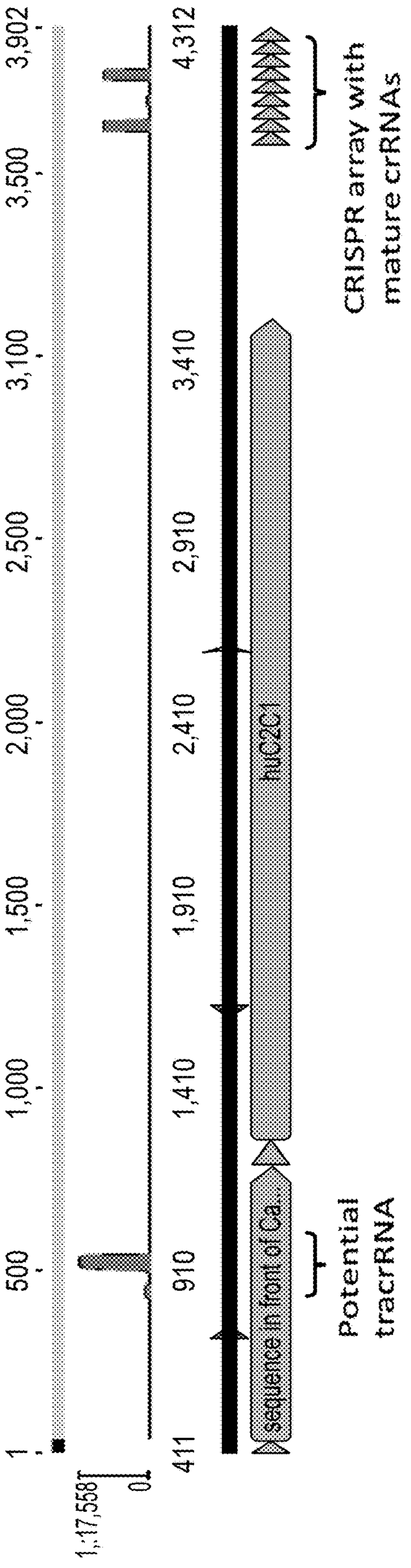
FIG. 7 depicts the *Planctomycetes* CRISPR-C2c1 locus. Small RNAseq revealed the location of the tracrRNA and the architecture of the mature crRNAs.
Figure 8A:
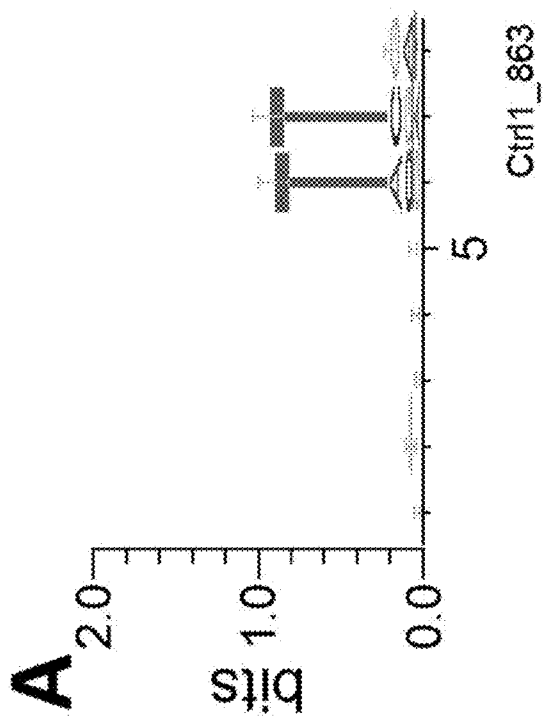
FIG. 8A shows results of a PAM screen for Seqlogos provided for the most relaxed predicted PAM and FIG. 8B shows the most stringent predicted PAM (B). The screen shows that the PAM for Planctolycetes is TTR (R=G or A).
Figure 8B:
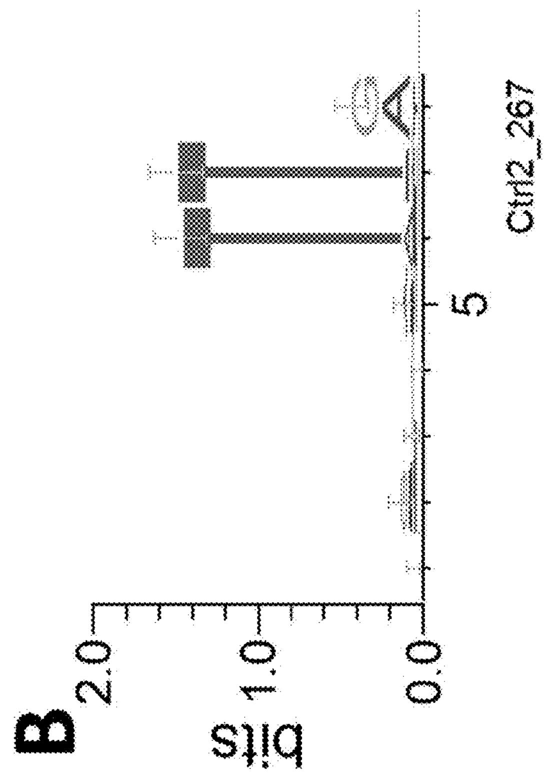
Figure 9:
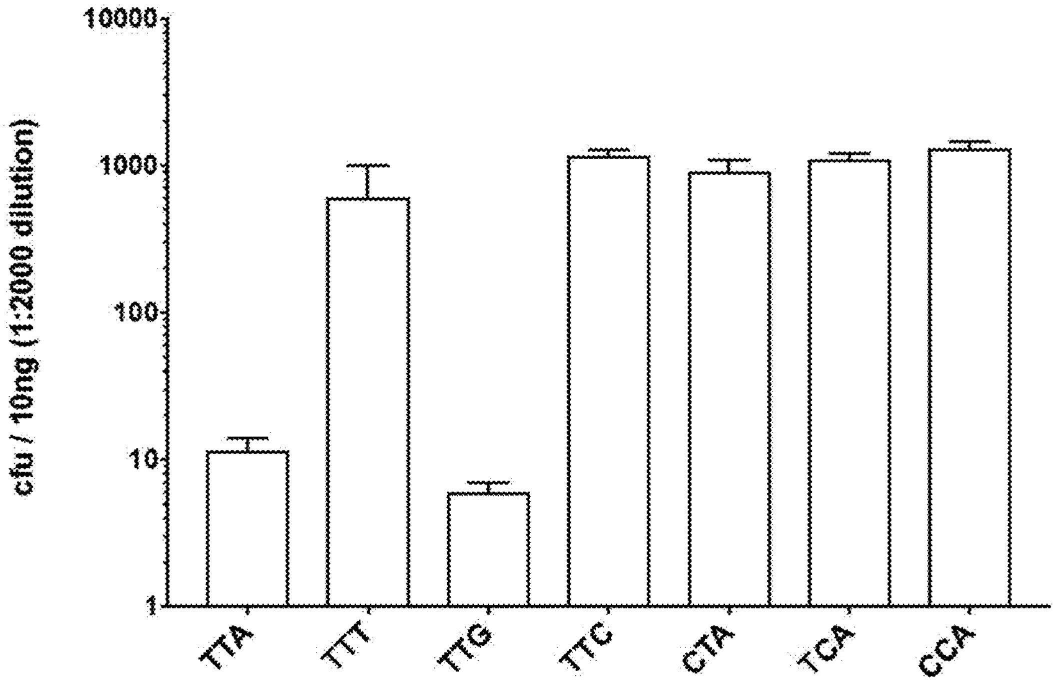
FIG. 9 shows in vivo confirmation of the *Planctomycetes* C2c1 PAM as TTR (R=G or A). Cells were transformed with plasmid DNA encoding different PAM sequences located 5' of a recognizable protospacer.
Figure 10:
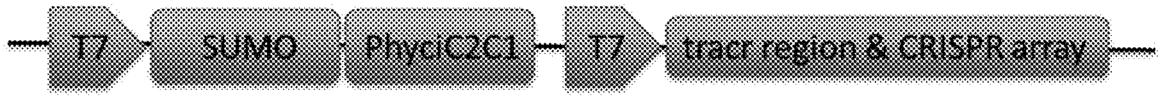
FIG. 10 shows an example of a plasmid for isolation of C2c1 with crRNA-tracrRNA complex. The plasmid contains PhyciC2c1 and/or tracrRNA and/or CRISPR array. Processed crRNAs and tracrRNA will complex with C2c1 and can be co-purified with the C2c1 protein (C2c1-RNA complexes).
Figure 11C:
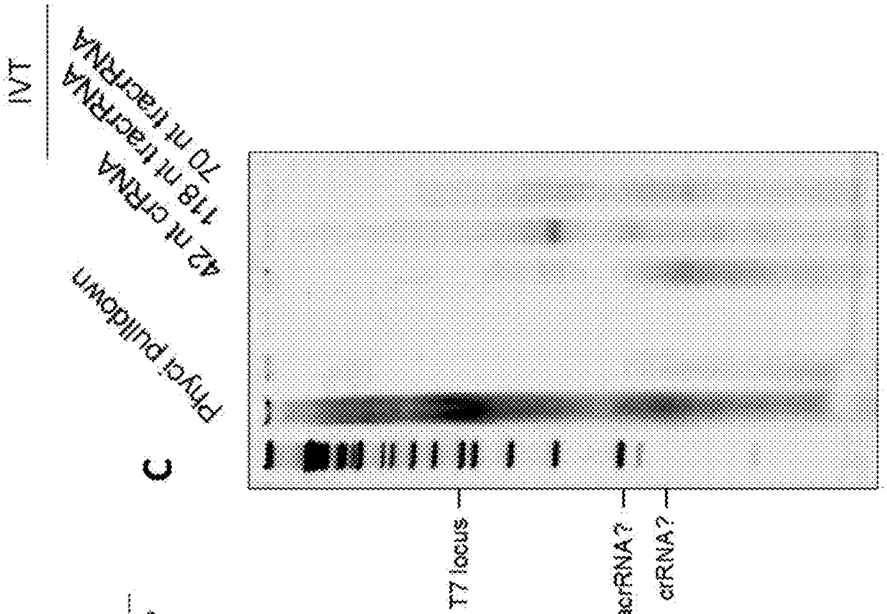
FIG. 11A shows bands of PhyciC2c1 and PlancC2c1 in a protein pulldown assay. RNase and DNase digestion experiments were performed, which demonstrated that RNA is present in PhysiC2c1 proteins (PhyC2c1 proteins were susceptible to RNase digestion but not DNase digestion) in FIG. 11B. The presence of RNA in the PhysiC2c1 proteins was further confirmed in FIG. 11C. The size of co-purified RNAs matches crRNA but appears larger than 118nt predicted tracrRNA.
Figure 11B:
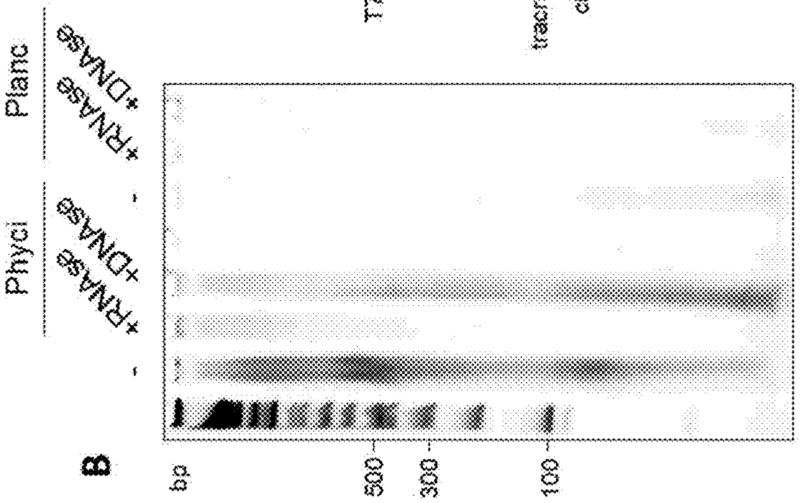
Figure 11A:
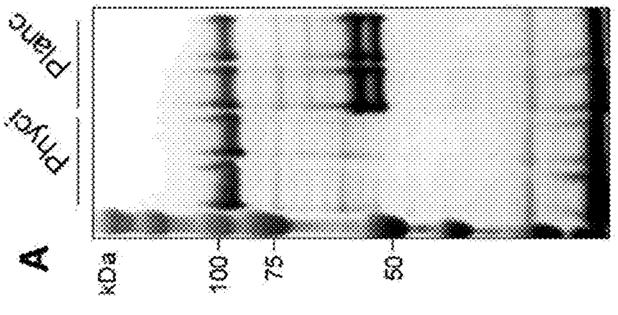
Figure 12:
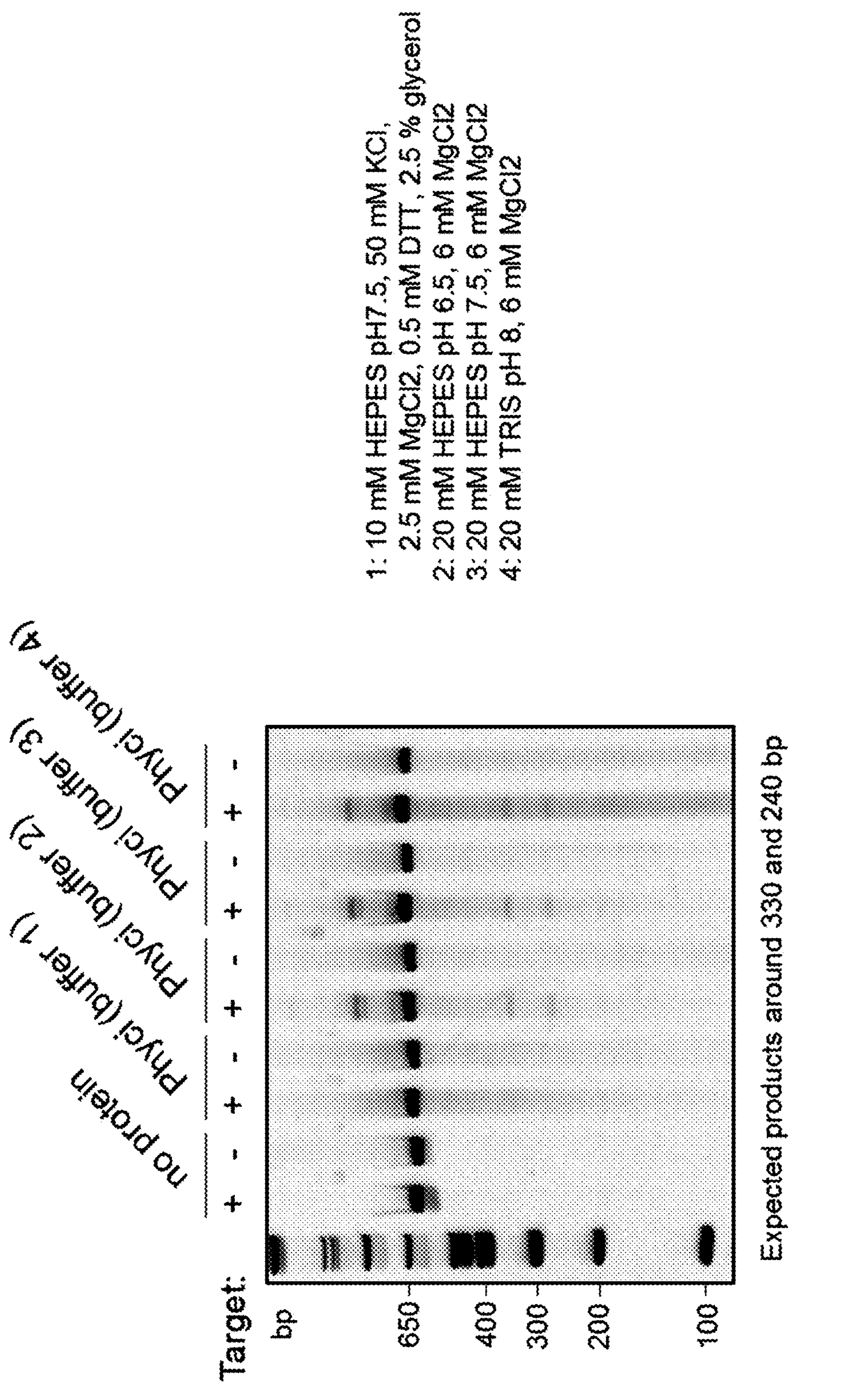
FIG. 12 provides conditions and results for in vitro cleavage experiment, which demonstrated that PhysiC2c1-RNA complex can cleave DNA containing a protospacer sequence matching the first guide of the CRISPR array.

DNA quadruplexes can be used for biomolecule analyte detection (FIG. 6). In one case, the OTA-aptamer (blue) recognizes OTA, causing a conformational change that exposes the quadruplex (red) to bind hemin. The hemin-quadruplex complex has peroxidase activity which can then oxidize the TMB substrate to a colored form (generally blue in solution). Accordingly, the quadruplexes can be degraded by CRISPR collateral activity described herein. Applicants have also created RNA forms of these quadruplexes that can be degraded as part of the CRISPR collateral activity described herein. Degradation causes a loss of RNA aptamer and thus a loss of color signal in the presence of nucleic acid target. Two exemplary designs are illustrated below.

```
                                    (SEQ ID NO: 514)
1) rUrGrGrGrUrUrGrGrGrUrUrGrGrGrUrUrGrGrGrA

                                    (SEQ ID NO: 515)
2) rUrGrGrGrUrUrUrGrGrGrUrUrUrGrGrGrUrUrUrGrGrGrA
```

The guanines form the key base pairs that generate the quadruplex structure and this then binds the hemin molecule. Applicants spaced the sets of guanines with uridine (shown in Bold) to allow degradation of the quadruplex as the di-nucleotide data shows that guanines are poorly degraded.

The colorimetric assay is applicable for use in diagnostic assays as described herein. In one embodiment, appropriate quadruplexes are incubated with a test sample and a Cas12 system. In another embodiment, appropriate quadruplexes are incubated with a test sample and a Cas13 system. For example, after an incubation period to allow Cas13 identification of a target sequence and for degradation of aptamers by collateral activity, substrate may be added. Absorbance may then be measured. In other embodiments, the substrate is included in the assay with the quadruplexes and a CRISPR Cas9, Cas12 or Cas13 system.

Example 5

Figure 13A:
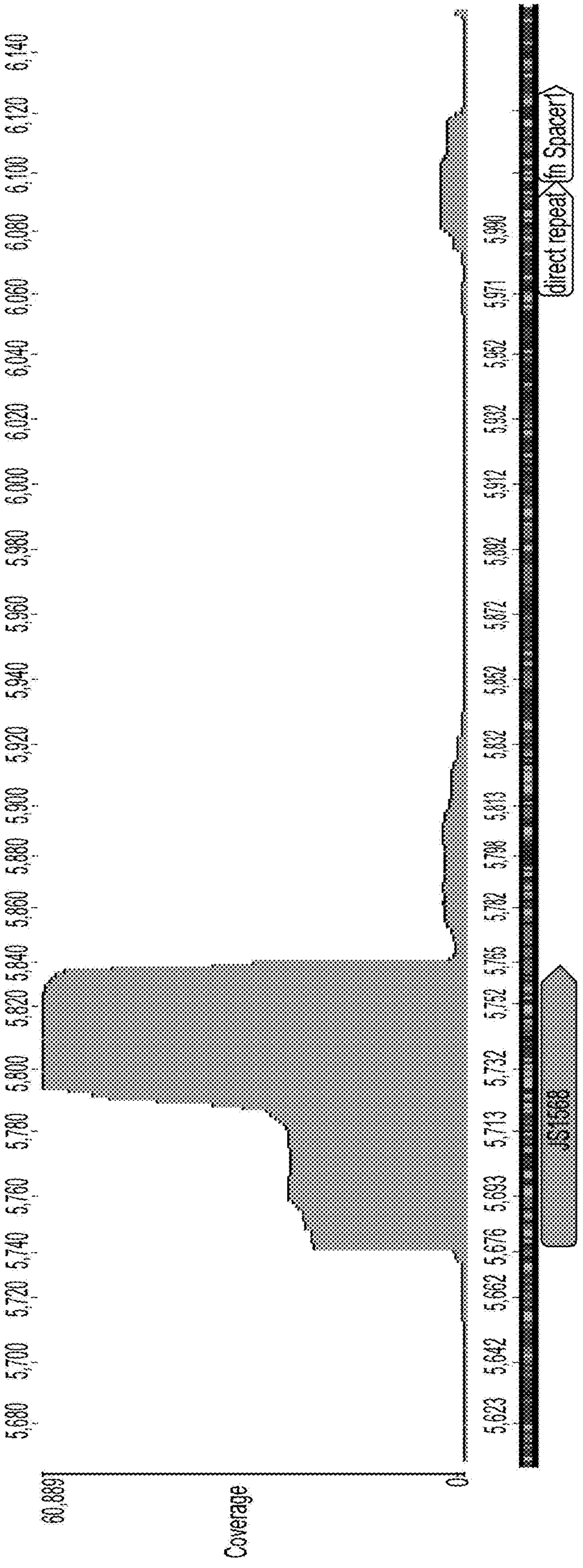
FIGS. 13A-13B shows different sgRNAs. Small RNA-seq from the BhCas12b locus expressed in *E. coli* revealed tracrRNA and crRNA. Diagram of fusions of tracrRNA and crRNA to form sgRNA variants. (SEQ ID NO:14-29)
Figure 13B:
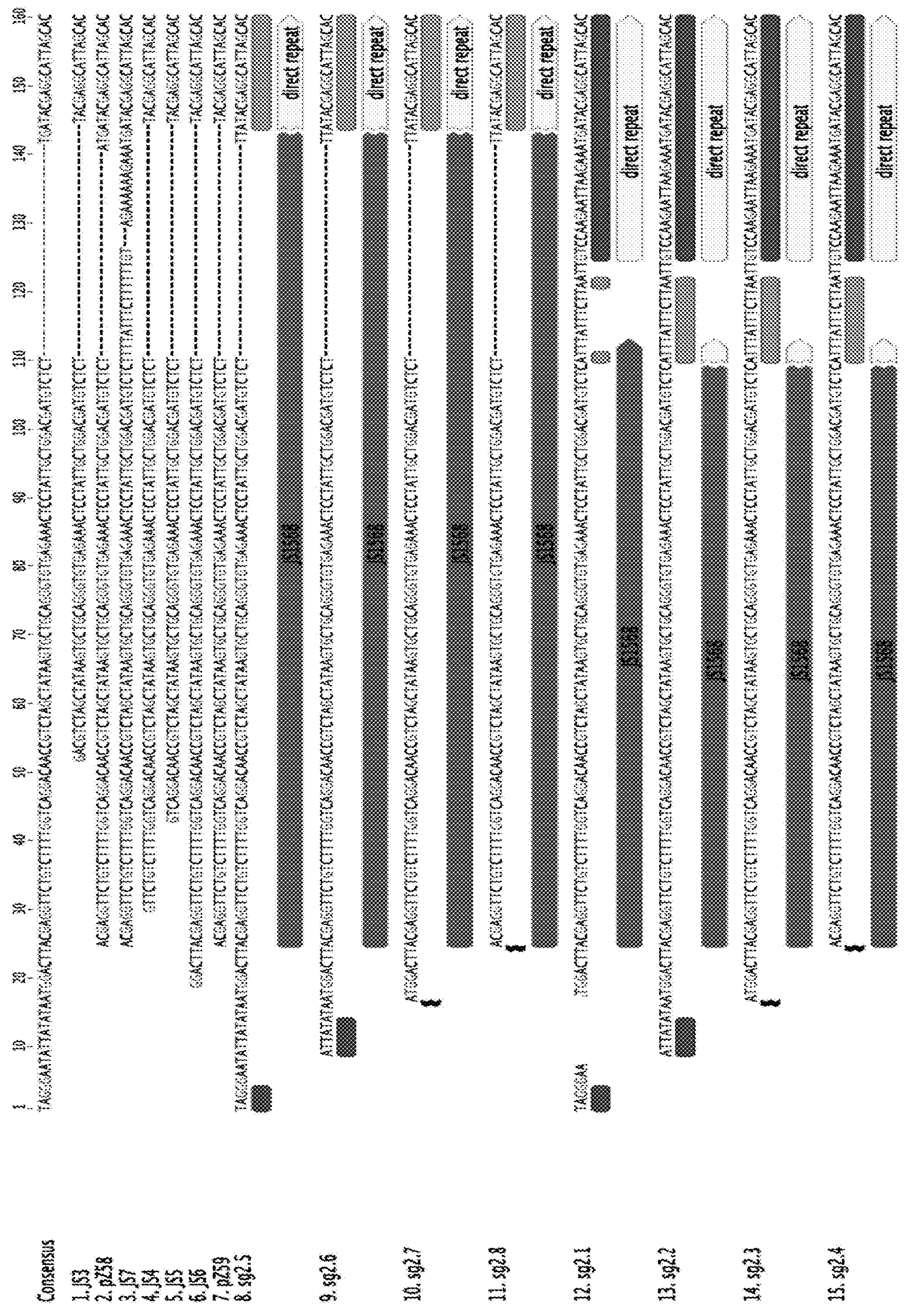
Figure 14A:
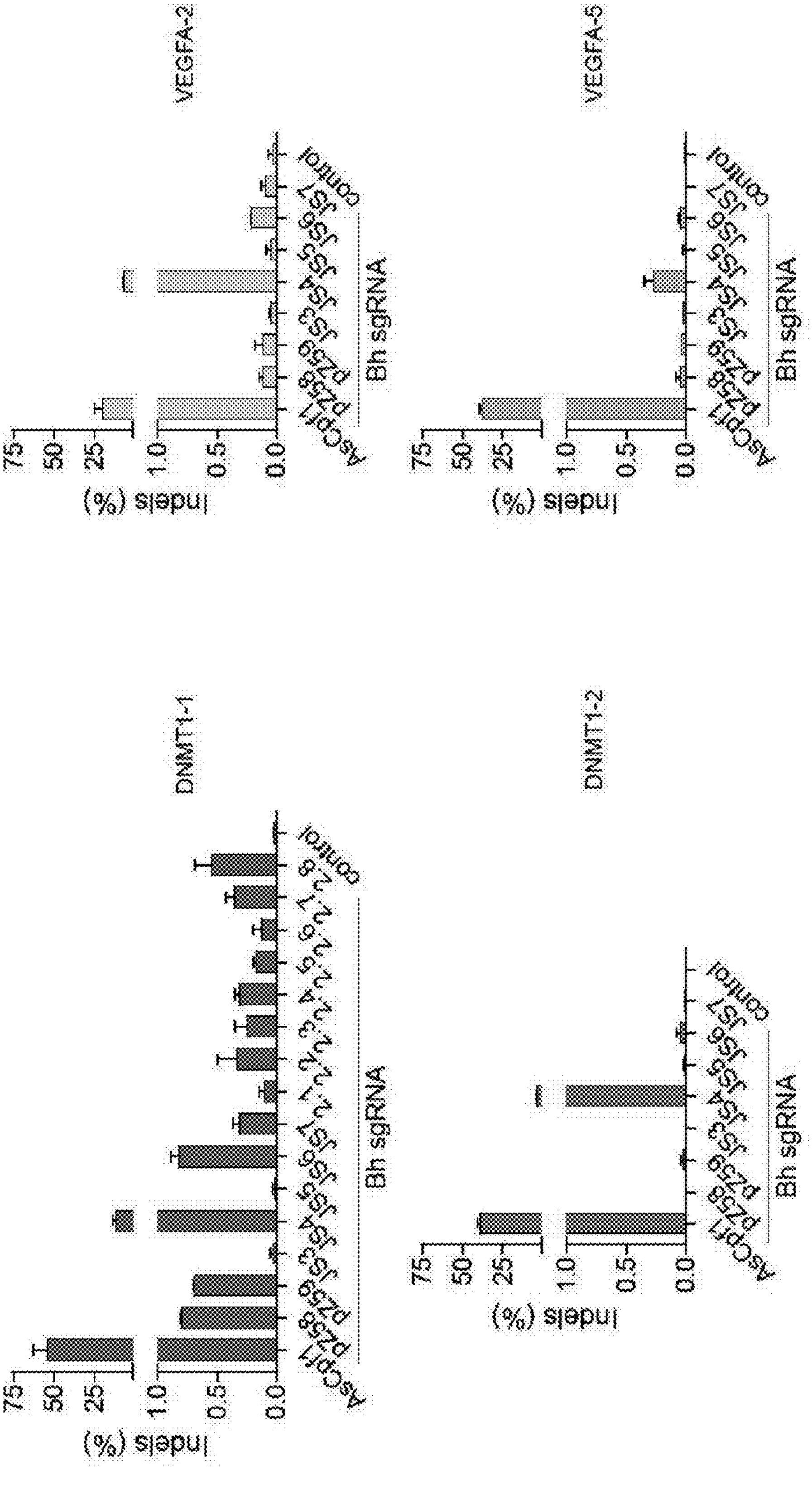
FIGS. 14A-14B shows indel percentages obtained with the different sgRNAs of FIGS. 13A-13B after plasmid transfection, for different target sites. Cas12b used was from *Bacillus hisashii* strain C4. Expression of BhCas12b and sgRNA variants in HEK293 cells generates indel mutations at multiple genomic sites.
Figure 14B:
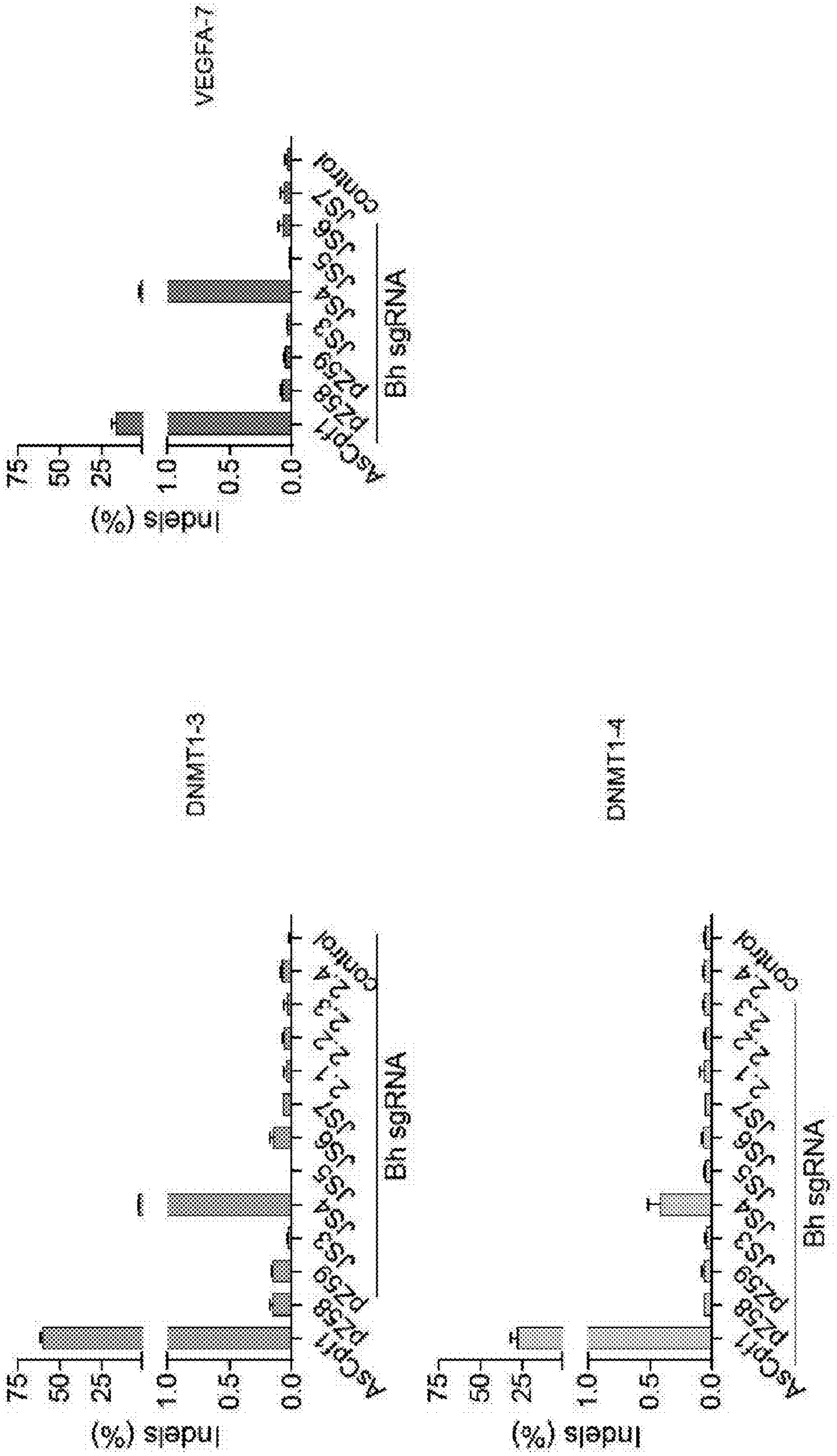

FIGS. 13A-13B shows different sgRNAs. FIGS. 14A-14B shows indel percentage obtained with the different sgRNAs of FIGS. 13A-13B after plasmid transfection, for different target sites. Cas12b used was from *Bacillus hisashii* strain C4.

Example 6

Table 14 shows exemplary orthologs of Cas12b.

TABLE 14

| Name | Accession No. | Organism | Sequence |
|---|---|---|---|
| Aac (*Alicyclobacillus acidoterrestris*) (SEQ ID NO: 516) | WP_0212 96342 | *Alicyclobacillus acidoterrestris* | MAVKSIKVKLRLDDMPEIRAGLWKLHKEV NAGVRYYTEWLSLLRQENLYRRSPNGDGE QECDKTAEECKAELLERLRARQVENGHRG PAGSDDELLQLARQLYELLVPQAIGAKGD AQQIARKFLSPLADKDAVGGLGIAKAGNK PRWVRMREAGEPGWEEEKEKAETRKSAD RTADVLRALADFGLKPLMRVYTDSEMSSV EWKPLRKGQAVRTWDRDMFQQAIERMMS WESWNQRVGQEYAKLVEQKNRFEQKNFV GQEHLVHLVNQLQQDMKEASPGLESKEQT AHYVTGRALRGSDKVFEKWGKLAPDAPF DLYDAEIKNVQRRNTRRFGSHDLFAKLAEP EYQALWREDASFLTRYAVYNSILRKLNHA KMFATFTLPDATAHPIWTRFDKLGGNLHQ YTFLFNEFGERRHAIRFHKLLKVENGVARE VDDVTVPISMSEQLDNLLPRDPNEPIALYFR DYGAEQHFTGEFGGAKIQCRRDQLAHMHR RRGARDVYLNVSVRVQSQSEARGERRPPY AAVFRLVGDNHRAFVHFDKLSDYLAEHPD DGKLGSEGLLSGLRVMSVDLGLRTSASISV FRVARKDELKPNSKGRVPFFFPIKGNDNLV AVHERSQLLKLPGETESKDLRAIREERQRT LRQLRTQLAYLRLLVRCGSEDVGRRERSW AKLIEQPVDAANHMTPDWREAFENELQKL KSLHGICSDKEWMDAVYESVRRVWRHMG KQVRDWRKDVRSGERPKIRGYAKDVVGG NSIEQIEYLERQYKFLKSWSFFGKVSGQVIR AEKGSRFAITLREHIDHAKEDRLKKLADRII MEALGYVYALDERGKGKWVAKYPPCQLI LLEELSEYQFNNDRPPSENNQLMQWSHRG VFQELINQAQVHDLLVGTMYAAFSSRFDA RTGAPGIRCRRVPARCTQEHNPEPFPWWL NKFVVEHTLDACPLRADDLIPTGEGEIFVSP FSAEEGDFHQIHADLNAAQNLQQRLWSDF DISQIRLRCDWGEVDGELVLIPRLTGKRTA DSYSNKVFYTNTGVTYYERERGKKRRKVF AQEKLSEEEAELLVEADEAREKSVVLMRD PSGIINRGNWTRQKEFWSMVNQRIEGYLV KQIRSRVPLQDSACENTGDI |

TABLE 14-continued

| Name | Accession No. | Organism | Sequence |
| --- | --- | --- | --- |
| Ak (*Alicyclobacillus kakegawensis*) (SEQ ID NO: 517) | WP_0679 36067 | *Alicyclobacillus kakegawensis* | MAVKSIKVKLRLSECPDILAGMWQLHRAT<br>NAGVRYYTEWVSLMRQEILYSRGPDGGQQ<br>CYMTAEDCQRELLRRLRNRQLHNGRQDQP<br>GTDADLLAISRRLYEILVLQSIGKRGDAQQI<br>ASSFLSPLVDPNSKGGRGEAKSGRKPAWQ<br>KMRDQGDPRWVAAREKYEQRKAVDPSKE<br>ILNSLDALGLRPLFAVFTETYRSGVDWKPL<br>GKSQGVRTWDRDMFQQALERLMSWESW<br>NRRVGEEYARLFQQKMKFEQEHFAEQSHL<br>VKLARALEADMRAASQGFEAKRGTAHQIT<br>RRALRGADRVFEIWKSIPEEALFSQYDEVIR<br>QVQAEKRRDFGSHDLFAKLAEPKYQPLWR<br>ADETFLTRYALYNGVLRDLEKARQFATFT<br>LPDACVNPIWTRFESSQGSNLHKYEFLFDH<br>LGPGRHAVRFQRLLVVESEGAKERDSVVV<br>PVAPSGQLDKLVLREEEKSSVALHLHDTAR<br>PDGFMAEWAGAKLQYERSTLARKARRDK<br>QGMRSWRRQPSMLMSAAQMLEDAKQAG<br>DVYLNISVRVKSPSEVRGQRRPPYAALFRI<br>DDKQRRVTVNYNKLSAYLEEHPDKQIPGA<br>PGLLSGLRVMSVDLGLRTSASISVFRVAKK<br>EEVEALGDGRPPHYYPIHGTDDLVAVHERS<br>HLIQMPGETETKQLRKLREERQAVLRPLFA<br>QLALLRLLVRCGAADERIRTRSWQRLTKQ<br>GREFTKRLTPSWREALELELTRLEAYCGRV<br>PDDEWSRIVDRTVIALWRRMGKQVRDWR<br>KQVKSGAKVKVKGYQLDVVGGNSLAQID<br>YLEQQYKFLRRWSFFARASGLVVRADRES<br>HFAVALRQHIENAKRDRLKKLADRILMEA<br>LGYVYEASGPREGQWTAQHPPCQLIILEEL<br>SAYRFSDDRPPSENSKLMAWGHRGILEELV<br>NQAQVHDVLVGTVYAAFSSRFDARTGAPG<br>VRCRRVPARFVGATVDDSLPLWLTEFLDK<br>HRLDKNLLRPDDVIPTGEGEFLVSPCGEEA<br>ARVRQVHADINAAQNLQRRLWQNFDITEL<br>RLRCDVKMGGEGTVLVPRVNNARAKQLF<br>GKKVLVSQDGVTFFERSQTGGKPHSEKQT<br>DLTDKELELIAEADEARAKSVVLFRDPSGH<br>IGKGHWIRQREFWSLVKQRIESHTAERIRV<br>RGVGSSLD |
| Am (*Alicyclobacillus macrosporangiidus*) (SEQ ID NO: 518) | WP_0749 48407 | *Alicyclobacillus macrosporangiidus* | MNVAVKSIKVKLMLGHLPEIREGLWHLHE<br>AVNLGVRYYTEWLALLRQGNLYRRGKDG<br>AQECYMTAEQCRQELLVRLRDRQKRNGH<br>TGDPGTDEELLGVARRLYELLVPQSVGKK<br>GQAQMLASGFLSPLADPKSEGGKGTSKSG<br>RKPAWMGMKEAGDSRWVEAKARYEANK<br>AKDPTKQVIASLEMYGLRPLFDVFTETYKT<br>IRWMPLGKHQGVRAWDRDMFQQSLERLM<br>SWESWNERVGAEFARLVDRRDRFREKHFT<br>GQEHLVALAQRLEQEMKEASPGFESKSSQ<br>AHRITKRALRGADGIIDDWLKLSEGEPVDR<br>FDEILRKRQAQNPRRFGSHDLFLKLAEPVF<br>QPLWREDPSFLSRWASYNEVLNKLEDAKQ<br>FATFTLPSPCSNPVWARFENAEGTNIFKYD<br>FLFDHFGKGRHGVRFQRMIVMRDGVPTEV<br>EGIVVPIAPSRQLDALAPNDAASPIDVFVGD<br>PAAPGAFRGQFGGAKIQYRRSALVRKGRR<br>EEKAYLCGFRLPSQRRTGTPADDAGEVFLN<br>LSLRVESQSEQAGRRNPPYAAVFHISDQTR<br>RVIVRYGEIERYLAEHPDTGIPGSRGLTSGL<br>RVMSVDLGLRTSAAISVFRVAHRDELTPDA<br>HGRQPFFFPIHGMDHLVALHERSHLIRLPG<br>ETESKKVRSIREQRLDRLNRLRSQMASLRL<br>LVRTGVLDEQKRDRNWERLQSSMERGGE<br>RMPSDWWDLFQAQVRYLAQHRDASGEA<br>WGRMVQAAVRTLWRQLAKQVRDWRKEV<br>RRNADKVKIRGIARDVPGGHSLAQLDYLE<br>RQYRFLRSWSAFSVQAGQVVRAERDSRFA<br>VALREHIDNGKKDRLKKLADRILMEALGY<br>VYVTDGRRAGQWQAVYPPCQLVLLEELSE<br>YRFSNDRPPSENSQLMVWSHRGVLEELIHQ<br>AQVHDVLVGTIPAAFSSRFDARTGAPGIRC<br>RRVPSIPLKDAPSIPIWLSHYLKQTERDAAA<br>LRPGELIPTGDGEFLVTPAGRGASGVRVVH<br>ADINAAHNLQRRLWENFDLSDIRVRCDRR |

TABLE 14-continued

| Name | Accession No. | Organism | Sequence |
|---|---|---|---|
| | | | EGKDGTVVLIPRLTNQRVKERYSGVIFTSE DGVSFTVGDAKTRRRSSASQGEGDDLSDE EQELLAEADDARERSVVLFRDPSGFVNGG RWTAQRAFWGMVHNRIETLLAERFSVSGA AEKVRG |
| Bh (*Bacillus hisashii*) (SEQ ID NO: 519) | WP_0951 42515 | *Bacillus hisashii* | MATRSFILKIEPNEEVKKGLWKTHEVLNHG IAYYMNILKLIRQEAIYEHHEQDPKNPKKV SKAEIQAELWDFVLKMQKCNSFTHEVDKD EVFNILRELYEELVPSSVEKKGEANQLSNK FLYPLVDPNSQSGKGTASSGRKPRWYNLKI AGDPSWEEEKKKWEEDKKKDPLAKILGKL AEYGLIPLFIPYTDSNEPIVKEIKWMEKSRN QSVRRLDKDMFIQALERFLSWESWNLKVK EEYEKVEKEYKTLEERIKEDIQALKALEQY EKERQEQLLRDTLNTNEYRLSKRGLRGWR EIIQKWLKMDENEPSEKYLEVFKDYQRKH PREAGDYSVYEFLSKKENHFIWRNHPEYPY LYATFCEIDKKKKDAKQQATFTLADPINHP LWVRFEERSGSNLNKYRILTEQLHTEKLKK KLTVQLDRLIYPTESGGWEEKGKVDIVLLP SRQFYNQIFLDIEEKGKHAFTYKDESIKFPL KGTLGGARVQFDRDHLRRYPHKVESGNV GRIYFNMTVNIEPTESPVSKSLKIHRDDFPK VVNFKPKELTEWIKDSKGKKLKSGIESLEIG LRVMSIDLGQRQAAAASIFEVVDQKPDIEG KLFFPIKGTELYAVHRASFNIKLPGETLVKS REVLRKAREDNLKLMNQKLNFLRNVLHFQ QFEDITEREKRVTKWISRQENSDVPLVYQD ELIQIRELMYKPYKDWVAFLKQLHKRLEV EIGKEVKHWRKSLSDGRKGLYGISLKNIDE IDRTRKFLLRWSLRPTEPGEVRRLEPGQRF AIDQLNHLNALKEDRLKKMANTIIMHALG YCYDVRKKKWQAKNPACQIILFEDLSNYN PYEERSRFENSKLMKWSRREIPRQVALQGE IYGLQVGEVGAQFSSRFHAKTGSPGIRCSV VTKEKLQDNRFFKNLQREGRLTLDKIAVL KEGDLYPDKGGEKFISLSKDRKCVTTHADI NAAQNLQKRFWTRTHGFYKVYCKAYQVD GQTVYIPESKDQKQKIIEEFGEGYFILKDGV YEWVNAGKLKIKKGSSKQSSSELVDSDILK DSFDLASELKGEKLMLYRDPSGNVFPSDK WMAAGVFFGKLERILISKLTNQYSISTIEDD SSKQSM |
| Bs (*Bacillus* sp. NSP2) (SEQ ID NO: 520) | WP_0265 57978 | *Bacillus* sp. NSP2 | MAIRSIKLKLKTHTGPEAQNLRKGIWRTHR LLNEGVAYYMKMLLLFRQESTGERPKEEL QEELICHIREQQQRNQADKNTQALPLDKAL EALRQLYELLVPSSVGQSGDAQIISRKFLSP LVDPNSEGGKGTSKAGAKPTWQKKKEAN DPTWEQDYEKWKKRREEDPTASVITTLEE YGIRPIFPLYTNTVTDIAWLPLQSNQFVRT WDRDMLQQAIERLLSWESWNKRVQEEYA KLKEKMAQLNEQLEGGQEWISLLEQYEEN RERELRENMTAANDKYRITKRQMKGWNE LYELWSTFPASASHEQYKEALKRVQQRLR GRFGDAHFFQYLMEEKNRLIWKGNPQRIH YFVARNELTKRLEEAKQSATMTLPNARKH PLWVRFDARGGNLQDYYLTAEADKPRSRR FVTFSQLIWPSESGWMEKKDVEVELALSR QFYQQVKLLKNDKGKQKIEFKDKGSGSTF NGHLGGAKLQLERGDLEKEEKNFEDGEIG SVYLNVVIDFEPLQEVKNGRVQAPYGQVL QLIRRPNEFPKVTTYKSEQLVEWIKASPQH SAGVESLASGFRVMSIDLGLRAAAATSIFS VEESSDKNAADFSYWIEGTPLVAVHQRSY MLRLPGEQVEKQVMEKRDERFQLHQRVK FQIRVLAQIMRMANKQYGDRWDELDSLK QAVEQKKSPLDQTDRTFWEGIVCDLTKVL PRNEADWEQAVVQIHRKAEEYVGKAVQA WRKRFAADERKGIAGLSMWNIEELEGLRK LLISWSRRTRNPQEVNRFERGHTSHQRLLT HIQNVKEDRLKQLSHAIVMTALGYVYDER KQEWCAEYPACQVILFENLSQYRSNLDRST KENSTLMKWAHRSIPKYVHMQAEPYGIQI GDVRAEYSSRFYAKTGTPGIRCKKVRGQD LQGRRFENLQKRLVNEQFLTEEQVKQLRP |

TABLE 14-continued

| Name | Accession No. | Organism | Sequence |
|---|---|---|---|
| | | | GDIVPDDSGELFMTLTDGSGSKEVVFLQAD INAAHNLQKRFWQRYNELFKVSCRVIVRD EEEYLVPKTKSVQAKLGKGLFVKKSDTAW KDVYVWDSQAKLKGKTTFTEESESPEQLE DFQEIIEEAEEAKGTYRTLFRDPSGVFFPES VWYPQKDFWGEVKRKLYGKLRERFLTKA R |
| Bt (*Bacillus thermoamylovorans*) (SEQ ID NO: 521) | WP_0419 02512 | *Bacillus thermoamylovorans* | MATRSFILKIEPNEEVKKGLWKTHEVLNHG IAYYMNILKLIRQEAIYEHHEQDPKNPKKV SKAEIQAELWDFVLKMQKCNSFTHEVDKD VVFNILRELYEELVPSSVEKKGEANQLSNK FLYPLVDPNSQSGKGTASSGRKPRWYNLKI AGDPSWEEEKKKWEEDKKKDPLAKILGKL AEYGLIPLFIPFTDSNEPIVKEIKWMEKSRN QSVRRLDKDMFIQALERFLSWESWNLKVK EEYEKVEKEHKTLEERIKEDIQAFKSLEQY EKERQEQLLRDTLNTNEYRLSKRGLRGWR EIIQKWLKMDENEPSEKYLEVFKDYQRKH PREAGDYSVYEFLSKKENHFIWRNHPEYPY LYATFCEIDKKKKDAKQQATFTLADPINHP LWVRFEERSGSNLNKYRILTEQLHTEKLKK KLTVQLDRLIYPTESGGWEEKGKVDIVLLP SRQFYNQIFLDIEEKGKHAFTYKDESIKFPL KGTLGGARVQFDRDHLRRYPHKVESGNV GRIYFNMTVNIEPTESPVSKSLKIHRDDFPK FVNFKPKELTEWIKDSKGKKLKSGIESLEIG LRVMSIDLGQRQAAAASIFEVVDQKPDIEG KLFFPIKGTELYAVHRASFNIKLPGETLVKS REVLRKAREDNLKLMNQKLNFLRNVLHFQ QFEDITEREKRVTKWISRQENSDVPLVYQD ELIQIRELMYKPYKDWVAFLKQLHKRLEV EIGKEVKHWRKSLSDGRKGLYGISLKNIDE IDRTRKFLLRWSLRPTEPGEVRRLEPGQRF AIDQLNHLNALKEDRLKKMANTIIMHALG YCYDVRKKKWQAKNPACQIILFEDLSNYN PYEERSRFENSKLMKWSRREIPRQVALQGE IYGLQVGEVGAQFSSRFHAKTGSPGIRCSV VTKEKLQDNRFFKNLQREGRLTLDKIAVL KEGDLYPDKGGEKFISLSKDRKLVTTHADI NAAQNLQKRFWTRTHGFYKVYCKAYQVD GQTVYIPESKDQKQKIIEEFGEGYFILKDGV YEWGNAGKLKIKKGSSKQSSSELVDSDILK DSFDLASELKGEKLMLYRDPSGNVFPSDK WMAAGVFFGKLERILISKLTNQYSISTIEDD SSKQSM |
| Bv (*Bacillus* sp. V3-13) (SEQ ID NO: 522) | WP_1016 61451 | *Bacillus* sp. V3-13 | MAIRSIKLKMKTNSGTDSIYLRKALWRTHQ LINEGIAYYMNLLTLYRQEAIGDKTKEAYQ AELINIIRNQQRNNGSSEEHGSDQEILALLR QLYELIIPSSIGESGDANQLGNKFLYPLVDP NSQSGKGTSNAGRKPRWKRLKEEGNPDW ELEKKKDEERKAKDPTVKIFDNLNKYGLLP LFPLFTNIQKDIEWLPLGKRQSVRKWDKD MFIQAIERLLSWESWNRRVADEYKQLKEK TESYYKEHLTGGEEWIEKIRKFEKERNMEL EKNAFAPNDGYFITSRQIRGWDRVYEKWS KLPESASPEELWKVVAEQQNKMSEGFGDP KVFSFLANRENRDIWRGHSERIYHIAAYNG LQKKLSRTKEQATFTLPDAIEHPLWIRYESP GGTNLNLFKLEEKQKKNYYVTLSKIIWPSE EKWIEKENIEIPLAPSIQFNRQIKLKQHVKG KQEISFSDYSSRISLDGVLGGSRIQFNRKYI KNHKELLGEGDIGPVFFNLVVDVAPLQETR NGRLQSPIGKALKVISSDFSKVIDYKPKELM DWMNTGSASNSFGVASLLEGMRVMSIDM GQRTSASVSIFEVVKELPKDQEQKLFYSIND TELFAIHKRSFLLNLPGEVVTKNNKQQRQE RRKKRQFVRSQIRMLANVLRLETKKTPDE RKKAIHKLMEIVQSYDSWTASQKEVWEKE LNLLTNMAAFNDEIWKESLVELHHRIEPYV GQIVSKWRKGLSEGRKNLAGISMWNIDEL EDTRRLLISWSKRSRTPGEANRIETDEPFGS SLLQHIQNVKDDRLKQMANLIIMTALGFK YDKEEKDRYKRWKETYPACQIILFENLNR YLFNLDRSRRENSRLMKWAHRSIPRTVSM QGEMFGLQVGDVRSEYSSRFHAKTGAPGI |

TABLE 14-continued

| Name | Accession No. | Organism | Sequence |
|---|---|---|---|
| | | | RCHALTEEDLKAGSNTLKRLIEDGFINESEL AYLKKGDIIPSQGGELFVTLSKRYKKDSDN NELTVIHADINAAQNLQKRFWQQNSEVYR VPCQLARMGEDKLYIPKSQTETIKKYFGKG SFVKNNTEQEVYKWEKSEKMKIKTDTTFD LQDLDGFEDISKTIELAQEQQKKYLTMFRD PSGYFFNNETWRPQKEYWSIVNNIIKSCLK KKILSNKVEL |
| CLb (*Candidatus Lindowbacteria*) (SEQ ID NO: 523) | OGH5599 4 | *Candidatus Lindowbacteria* | MPRDDLDLLTNLNSTAKGIRERGKTKEGT DKKKSGRKSSWPMDKAAWETAKTSDSSA HFLEKLKQHPDLKDAFGNLSSGGSKKLEY YKKLAGSAPWKESQSVILEKAARWKEAKQ EREEKEQDSSEHGSKAAYRRLFDAGCLPM PEFAKYIDENQIEFGDLKLSDCGAEWKRG MWNQAGQRVRSHMGWQRRREKENAVYS LRKELFEKGGAIRRKKSEELTPEDILPGKAA PDQNDWQERPAYGNQMWFIGLRSYEENE MAKYAEEAGMGSRSAPRIRRGTIKGWSKL RERWLQILKRNPQATRDDLIGELNALRSQD PRAYGDARLFDWLSKTDQRFLWDGFDAD GKILCGRDDRDCVSAFVAYNEEFADEPSSI TLTETDERLHPVWPFFGESSAVPYEIEYDLE TACPTAIRLPLLVGKENGGYAERQGTRLPL AEYADLASSFQLPTPVRLDVLVEIREVTRA GRKVTCPFSYFKQNGVWYVREGEIPSGESI QIKQTDRKIENGKIFISSKLRMAYRDDLMV SPATGDFGSIKILWERIELASHVDQKKLPET APARSRVFVSFSCNVVERAPRKQLTRKPDA VVVTIPSGVDQGLVVVSTDVRTGKSKSSSA PPLPPGSRLWPADAVHGDPPLRILSVDLGH RHSAYAVWELGLQQKSWRAGVLKGSTQT PVYADCTGTGLLCLPGDGEDTPAEEESLRL RSRQIRRRLNLQNSILRVSRLLSLDKFEKTIF EQSDVRDRPNKKGLRIRRRCRTEKTPLSEA EVRKNCDKAAEILIRWADTDAMAKSLAAT GNADISFWKYMAVKNPPLSAVVDVAPSTI VPDDGPDRETLKKKRQEEEEKFASSIYENR VKLAGALCSGYDADHRRPATGGLWHDLD RTLIREISYGDRGQKGNPRKLNNEGILRLLR RPPRARPDWREFHRTLNDANRIPKGRTLRG GLSMGRLNFLKEVGDFVKKWSCRPRWPG DRRHIPPGQLFDRQDAEHLEHLRDDRIKRL AHLIVAQALGFEPDIRRGLWKYVDGSTGEI LWQHPETRRFFAEGAAGELREVSRPAEIDD DAAARPHTVSAPAHIVVFENLIRYRFQSDR PKTENAGLMQWAHRQIVHFTKQVASLYGL KVAMVYAAFSSKFCSRCGSPGARVSRFDP AWRNQEWFKRRTSNPRSKVDHSLKRASED PTADETRPWVLIEGGKEFVCANAKCSAHD EPLNADENAAANIGLRFLRGVEDFRTKVNP AGALKGKLRFETGIHSFRPPVSGSPFWSPM AEPAQKKKIGAAAPGADVDEAGDADESGV VVLFRDPSGAFRNKQYWYEGKIFWSNVM MAVEAKIAGASVGAKPVAASWGQAQPQS GPGLAKPGGD |
| Db (*Desulfatirhabdium butyrativorans*) (SEQ ID NO: 524) | WP_0283 26052 | *Desulfatirhabdium butyrativorans* | MPLSNNPPVTQRAYTLRLRGADPSDLSWR EALWHTHEAVNKGAKVFGDWLLTLRGGL DHTLADTKVKGGKGKPDRDPTPEERKARR ILLALSWLSVESKLGAPSSYIVASGDEPAKD RNDNVVSALEEILQSRKVAKSEIDDWKRD CSASLSAAIRDDAVWVNRSKVFDEAVKSV GSSLTREEAWDMLERFFGSRDAYLTPMKD PEDKSSETEQEDKAKDLVQKAGQWLSSRY GTSEGADFCRMSDIYGKIAAWADNASQGG SSTVDDLVSELRQHFDTKESKATNGLDWII GLSSYTGHTPNPVHELLRQNTSLNKSHLDD LKKKANTRAESCKSKIGSKGQRPYSDAILN DVESVCGFTYRVDKDGQPVSVADYSKYD VDYKWGTARHYIFAVMLDHAARRISLAHK WIKRAEAERHKFEEDAKRIANVPARAREW LDSFCKERSVTSGAVEPYRIRRRAVDGWK EVVAAWSKSDCKSTEDRIAAARALQDDSEI DKFGDIQLFEALAEDDALCVWHKDGEATN EPDFQPLIDYSLAIEAEFKKRQFKVPAYRHP DELLHPVFCDFGKSRWKINYDVHKNVQAP |

TABLE 14-continued

| Name | Accession No. | Organism | Sequence |
|---|---|---|---|
| | | | FYRGLCLTLWTGSEIKPVPLCWQSKRLTRD LALGNNHRNDAASAVTRADRLGRAASNV TKSDMVNITGLFEQADWNGRLQAPRQQLE AIAVVRDNPRLSEQERNLRMCGMIEHIRWL VTFSVKLQPQGPWCAYAEQHGLNTNPQY WPHADTNRDRKVHARLILPRLPGLRVLSV DLGHRYAAACAVWEAVNTETVKEACQNV GRDMPKEHDLYLHIKVKKQGIGKQTEVDK TTIYRRIGADTLPDGRPHPAPWARLDRQFLI KLQGEEKDAREASNEEIWALHQMECKLDR TKPLIDRLIASGWGLLKRQMARLDALKEL GWIPAPDSSENLSREDGEAKDYRESLAVDD LMFSAVRTLRLALQRHGNRARIAYYLISEV KIRPGGIQEKLDENGRIDLLQDALALWHEL FSSPGWRDEAAKQLWDSRIATLAGYKAPE ENGDNVSDVAYRKKQQVYREQLRNVAKT LSGDVITCKELSDAWKERWEDEDQRWKK LLRWFKDWVLPSGTQANNATIRNVGGLSL SRLATITEFRRKVQVGFFTRLRPDGTRHEIG EQFGQKTLDALELLREQRVKQLASRIAEAA LGIGSEGGKGWDGGKRPRQRINDSRFAPC HAVVIENLANYRPDETRTRLENRRLMTWS ASKVHKYLSEACQLNGLYLCTVSAWYTSR QDSRTGAPGIRCQDVSVREFMQSPFWRKQ VKQAEAKHDENKGDARERFLCELNKTWK AKTPAEWKKAGFVRIPLRGGEIFVSADSKS PSAKGIHADLNAAANIGLRALTDPDWPGK WWYVPCDPVSFESKMDYVKGCAAVKVG QPLRQPAQTNADGAASKIRKGKKNRTAGT SKEKVYLWRDISAFPLESNEIGEWKETSAY QNDVQYRVIRMLKEHIKSLDNRTGDNVEG |
| Dt (*Desulfonatronum thiodismutans*) (SEQ ID NO: 525) | WP_0313 86437 | *Desulfonatronum thiodismutans* | MVLGRKDDTAELRRALWTTHEHVNLAVA EVERVLLRCRGRSYWTLDRRGDPVHVPES QVAEDALAMAREAQRRNGWPVVGEDEEI LLALRYLYEQIVPSCLLDDLGKPLKGDAQK IGTNYAGPLFDSDTCRRDEGKDVACCGPFH EVAGKYLGALPEWATPISKQEFDGKDASH LRFKATGGDDAFFRVSIEKANAWYEDPAN QDALKNKAYNKDDWKKEKDKGISSWAVK YIQKQLQLGQDPRTEVRRKLWLELGLLPLF IPVFDKTMVGNLWNRLAVRLALAHLLSWE SWNHRAVQDQALARAKRDELAALFLGME DGFAGLREYELRRNESIKQHAFEPVDRPYV VSGRALRSWTRVREEWLRHGDTQESRKNI CNRLQDRLRGKFGDPDVFHWLAEDGQEA LWKERDCVTSFSLLNDADGLLEKRKGYAL MTFADARLHPRWAMYEAPGGSNLRTYQIR KTENGLWADVVLLSPRNESAAVEEKTFNV RLAPSGQLSNVSFDQIQKGSKMVGRCRYQ SANQQFEGLLGGAEILFDRKRIANEQHGAT DLASKPGHVWFKLTLDVRPQAPQGWLDG KGRPALPPEAKHFKTALSNKSKFADQVRP GLRVLSVDLGVRSFAACSVFELVRGGPDQ GTYFPAADGRTVDDPEKLWAKHERSFKIT LPGENPSRKEEIARRAAMEELRSLNGDIRR LKAILRLSVLQEDDPRTEHLRLFMEAIVDD PAKSALNAELFKGFGDDRFRSTPDLWKQH CHFFHDKAEKVVAERFSRWRTETRPKSSS WQDWRERRGYAGGKSYWAVTYLEAVRG LILRWNMRGRTYGEVNRQDKKQFGTVAS ALLHHINQLKEDRIKTGADMIIQAARGFVP RKNGAGWVQVHEPCRLILFEDLARYRFRT DRSRRENSRLMRWSHREIVNEVGMQGELY GLHVDTTEAGFSSRYLASSGAPGVRCRHL VEEDFHDGLPGMHLVGELDWLLPKDKDR TANEARRLLGGMVRPGMLVPWDGGELFA TLNAASQLHVIHADINAAQNLQRRFWGRC GEAIRIVCNQLSVDGSTRYEMAKAPKARLL GALQQLKNGDAPFHLTSIPNSQKPENSYVM TPTNAGKKYRAGPGEKSSGEEDELALDIVE QAEELAQGRKTFFRDPSGVFFAPDRWLPSE IYWSRIRRRIWQVTLERNSSGRQERAEMDE MPY |

TABLE 14-continued

| Name | Accession No. | Organism | Sequence |
|---|---|---|---|
| Eb (*Elusimicrobia bacterium*) (SEQ ID NO: 526) | OGS0232 6 | *Elusimicrobia bacterium* | MNRIYQGRVTKVEVPDGKDEKGNIKWKK LENWSDILWQHHMLFQDAVNYYTLALAAI SGSAVGSDEKSIILREWAVQVQNIWEKAK KKATVFEGPQKRLTSILGLEQNASFDIAAK HILRTSEAKPEQRASALIRLLEEIDKKNHNV VCGERLPFFCPRNIQSKRSPTSKAVSSVQEQ KRQEEVRRFHNMQPEEVVKNAVTLDISLF KSSPKIVFLEDPKKARAELLKQFDNACKKH KELVGIKKAFTESIDKHGSSLKVPAPGSKPS GLYPSAIVFKYFPVDITKTVFLKATEKLAM GKDREVTNDPIADARVNDKPHFDYFTNIAL IREKEKNRAAWFEFDLAAFIEAIMSPHRFY QDTQKRKEAARKLEEKIKAIEGKGGQFKES DSEDDDVDSLPGFEGDTRIDLLRKLVTDTL GWLGESETPDNNEGKKTEYSISERTLRIFPD IQKQWSELAEKGETTEGKLLEVLKHEQTE HQSDFGSATLYQHLAKPEFHPIWLKSGTEE WHAENPLKAWLNYKELQYELTDKKRPIHF TPAHPVYSPRYFDFPKKSETEEKEVSKNTH SLTTSLASEHIKNSLQFTAGLIRKTNVGKKA IKARFSYSAPRLRRDCLRSENNENLYKAPW LQPMMRALGIDEEKADRQNFANTRITLMA KGLDDIQLGFPVEANSQELQKEVSNGISWK GQFNWGGIASLSALRWPHEKKPKNPPEQP WWGIDSFSCLAVDLGQRYAGAFARLDVST IEKKGKSRFIGEACDKKWYAKVSRMGLLR LPGEDVKVWRDASKIDKENGFAFRKELFG EKGRSATPLEAEETAELIKLFGANEKDVMP DNWSKELSFPEQNDKLLIVARRAQAAVSR LHRWAWFFDEAKRSDDAIREILESDDTDLK QKVNKNEIEKVKETIISLLKVKQELLPTLLT RLANRVLPLRGRSWEWKKHHQKNDGFILD QTGKAMPNVLIRGQRGLSMDRIEQITELRK RFQALNQSLRRQIGKKAPAKRDDSIPDCCP DLLEKLDHMKEQRVNQTAHMILAEALGLK LAEPPKDKKELNETCDMHGAYAKVDNPVS FIVIEDLSRYRSSQGRSPRENSRLMKWCHR AVRDKLKEMCEVFFPLCERRKAGSAWVSL PPLLETPAAYSSRFCSRSGVAGFRAVEVIPG FELKYPWSWLKDKKDKAGNLAKEALNIRT VSEQLKAFNQDKPEKPRTLLVPIAGGPIFVP ISEVGLSSFGLKPQVVQADINAAINLGLRAI SDPRIWEIHPRLRTEKRDGRLFAREKRKYG EEKVEVQPSKNEKAKKVKDDRKPNYFADF SGKVDWGEGNIKNESGLTLVSGKALWWTI NQLQWERCFDINKRHIEDWSNKQKQ |
| Lb (*Lentisphaeria bacterium*) (SEQ ID NO: 527) | | *Lentisphaeria bacterium* | MAVELNRIYQGRVNHVYIFDENQNQVSVD NGDDLLFVHHELYQDAINYYLVALAAMA LDSKDSLFGKFKMQIRAVWNDFYRNGQLR PGLKHSLIRSLGHAAELNTSNGADIAMNLI LEDGGIPSEILNAALEHLAEKCTGDVSQLG KTFFPRFCDTAYHGNWDVDAKSFSEKKGR QRLVDALYSLHPVQAVQELAPEIEIGWGG VKTQTGKFFTGDEAKASLKKAISYFLQDTG KNSPELQEYFSVAGKQPLEQYLGKIDTFPEI SFGRISSHQNINISNAMWILKFFPDQYSVDL IKNLIPNKKYEIGIAPQWGDDPVKLSRGKR GYTFRAFTDLAMWEKNWKVFDRAAFSDA LKTINQFRNKTQERNDQLKRYCAALNWM DGESSDKKPPVEPADADAVDEAATSVLPIL AGDKRWNALLQLQKELGICNDFTENELMD YGLSLRTIRGYQKLRSMMLEKEEKMRAKT ADDEEISQALQEIIIKFQSSHRDTIGSVSLFL KLAEPKYFCVWHDADKNQNFASVDMVAD AVRYYSYQEEKARLEEPIQITPADARYSRR VSDLYALVYKNAKECKTGYGLRPDGNFVF EIAQKNAKGYAPAKVVLAFSAPRLKRDGLI DKEFSAYYPPVLQAFLREEEAPKQSFKTTA VILMPDWDKNGKRRILLNFPIKLDVSAIHQ KTDHRFENQFYFANNTNTCLLWPSYQYKK PVTWYQGKKPFDVVAVDLGQRSAGAVSRI TVSTEKREHSVAIGEAGGTQWYAYRKFSG LLRLPGEDATVIRDGQRTEELSGNAGRLST EEETVQACVLCKMLIGDATLLGGSDEKTIR SFPKQNDKLLIAFRRATGRMKQLQRWLW |

TABLE 14-continued

| Name | Accession No. | Organism | Sequence |
|---|---|---|---|
| | | | MLNENGLCDKAKTEISNSDWLVNKNIDNV LKEEKQHREMLPAILLQIADRVLPLRGRKW DWVLNPQSNSFVLQQTAHGSGDPHKKICG QRGLSFARIEQLESLRMRCQALNRILMRKT GEKPATLAEMRNNPIPDCCPDILMRLDAM KEQRINQTANLILAQALGLRHCLHSESATK RKENGMHGEYEKIPGVEPAAFVVLEDLSR YRFSQDRSSYENSRLMKWSHRKILEKLALL CEVFNVPILQVGAAYSSKFSANAIPGFRAE ECSIDQLSFYPWRELKDSREKALVEQIRKIG HRLLTFDAKATIIMPRNGGPVFIPFVPSDSK DTLIQADINASFNIGLRGVADATNLLCNNR VSCDRKKDCWQVKRSSNFSKMVYPEKLSL SFDPIKKQEGAGGNFFVLGCSERILTGTSEK SPVFTSSEMAKKYPNLMFGSALWRNEILKL ERCCKINQSRLDKFIAKKEVQNEL |
| Ls (*Laceyella sediminis*) (SEQ ID NO: 528) | WP_1063 41859 | *Laceyella sediminis* | MSIRSFKLKIKTKSGVNAEELRRGLWRTHQ LINDGIAYYMNWLVLLRQEDLFIRNEETNE IEKRSKEEIQGELLERVHKQQQRNQWSGEV DDQTLLQTLRHLYEEIVPSVIGKSGNASLK ARFFLGPLVDPNNKTTKDVSKSGPTPKWK KMKDAGDPNWVQEYEKYMAERQTLVRLE EMGLIPLFPMYTDEVGDIHWLPQASGYTRT WDRDMFQQAIERLLSWESWNRRVRERRA QFEKKTHDFASRFSESDVQWMNKLREYEA QQEKSLEENAFAPNEPYALTKKALRGWER VYHSWMRLDSAASEEAYWQEVATCQTAM RGEFGDPAIYQFLAQKENHDIWRGYPERVI DFAELNHLQRELRRAKEDATFTLPDSVDHP LWVRYEAPGGTNIHGYDLVQDTKRNLTLI LDKFILPDENGSWHEVKKVPFSLAKSKQFH RQVWLQEEQKQKKREVVFYDYSTNLPHL GTLAGAKLQWDRNFLNKRTQQQIEETGEI GKVFFNISVDVRPAVEVKNGRLQNGLGKA LTVLTHPDGTKIVTGWKAEQLEKWVGESG RVSSLGLDSLSEGLRVMSIDLGQRTSATVS VFEITKEAPDNPYKFFYQLEGTELFAVHQR SFLLALPGENPPQKIKQMREIRWKERNRIK QQVDQLSAILRLHKKVNEDERIQAIDKLLQ KVASWQLNEEIATAWNQALSQLYSKAKEN DLQWNQAIKNAHHQLEPVVGKQISLWRK DLSTGRQGIAGLSLWSIEELEATKKLLTRW SKRSREPGVVKRIERFETFAKQIQHHINQVK ENRLKQLANLIVMTALGYKYDQEQKKWIE VYPACQVVLFENLRSYRFSYERSRRENKKL MEWSHRSIPKLVQMQGELFGLQVADVYA AYSSRYHGRTGAPGIRCHALTEADLRNETN IIHELIEAGFIKEEHRPYLQQGDLVPWSGGE LFATLQKPYDNPRILTLHADINAAQNIQKR FWHPSMWFRVNCESVMEGEIVTYVPKNKT VHKKQGKTFRFVKVEGSDVYEWAKWSKN RNKNTFSSITERKPPSSMILFRDPSGTFFKEQ EWVEQKTFWGKVQSMIQAYMKKTIVQRM EE |
| Mn (*Methylobacterium nodulans*) (SEQ ID NO: 529) | WP_0437 47912 | *Methylobacterium nodulans* | MYEAIVLADDANAQLANAFLGPLTDPNSA GFLEAFNKVDRPAPSWLDQVPASDPIDPAV LAEANAWLDTDAGRAWLVDTGAPPRWRS LAAKQDPIWPREFARKLGELRKEAASGTSA IIKALKRDFGVLPLFQPSLAPRILGSRSSLTP WDRLAFRLAVGHLLSWESWCTRARDEHT ARVQRLEQFSSAHLKGDLATKVSTLREYE RARKEQIAQLGLPMGERDFLITVRMTRGW DDLREKWRRSGDKGQEALHAIIATEQTRK RGRFGDPDLFRWLARPENHHVWADGHAD AVGVLARVNAMERLVERSRDTALMTLPDP VAHPRSAQWEAEGGSNLRNYQLEAVGGE LQITLPLLKAADDGRCIDTPLSFSLAPSDQL QGVVLTKQDKQQKITYCTNMNEVFEAKLG SADLLLNWDHLRGRIRDRVDAGDIGSAFL KLALDVAHVLPDGVDDQLARAAFHFQSA KGAKSKHADSVQAGLRVLSIDLGVRSFAT CSVFELKDTAPTTGVAFPLAEFRLWAVHER SFTLELPGENVGAAGQQWRAQADAELRQL RGGLNRHRQLLRAATVQKGERDAYLTDLR EAWSAKELWPFEASLLSELERCSTVADPL |

TABLE 14-continued

| Name | Accession No. | Organism | Sequence |
|---|---|---|---|
| | | | WQDTCKRAARLYRTEFGAVVSEWRSRTRS<br>REDRKYAGKSMWSVQHLTDVRRFLQSWS<br>LAGRASGDIRRLDRERGGVFAKDLLDHIDA<br>LKDDRLKTGADLIVQAARGFQRNEFGYWV<br>QKHAPCHVILFEDLSRYRMRTDRPRRENSQ<br>LMQWAHRGVPDMVGMQGEIYGIQDRRDP<br>DSARKHARQPLAAFCLDTPAAFSSRYHAST<br>MTPGIRCHPLRKREFEDQGFLELLKRENEG<br>LDLNGYKPGDLVPLPGGEVFVCLNANGLS<br>RIHADINAAQNLQRRFWTQHGDAFRLPCG<br>KSAVQGQIRWAPLSMGKRQAGALGGFGY<br>LEPTGHDSGSCQWRKTTEAEWRRLSGAQK<br>DRDEAAAAEDEELQGLEEELLERSGERVVF<br>FRDPSGVVLPTDLWFPSAAFWSIVRAKTVG<br>RLRSHLDAQAEASYAVAAGL |
| Ob (*Omnitrophica bacterium*) (SEQ ID NO: 530) | WP_0095 13281 | *Omnitrophica* WOR_2 | MNRIYQGRVTKVEKLKNGKSPDDREELKD<br>WQTALWRHHELFQDAVSYYTLALAAMAE<br>GLPDKHPINVLRKRMEEAWEEFPRKTVTP<br>AKNLRDSVRPWLGLSESASFGDALKKILPP<br>APENKEVRALAVALLAEKARTLKPQKTSA<br>SYWGRFCDDLKKKPNWDYSEEELARKTGS<br>GDWVAGLWSEDALNKIDELAKSLKLSSLV<br>KCVPDGQINPEGARNLVKEALDHLEGVSN<br>GTKKEKNDPGPAKKTNNWLRQHASDVRN<br>FIHKNKNQFSSLPNGRLITERARGGGININK<br>TYAGVLFKAFPCPFTFDYVRAAVPEPKVK<br>KVDQEKKSEQSATWTELEKRILRIGDDPIEL<br>ARKNNKPIFKAFTALEKWSDQNSKSCWSD<br>FDKCAFEEALKTLNQFNQKTEEREKRRSEA<br>EAELKYMMDENPEWKPKKETEGDDVREV<br>PILKGDPRYEKLVKLFGDLDEEGSEHATGK<br>IYGPSRASLRGFGKLRNEWVDLFTKANDN<br>PREQDLQKAVTGFQREHKLDMGYTAFFLK<br>LCERDYWDIWRDDTEVEVKKIREKRWVKS<br>VVYAAADTRELAEELERLQEPVRYTPAEP<br>QFSRRLFMFSDIKGKQGAKHIREGLVEVSL<br>AVKDQSGKYGTCRVRLHYSAPRLIRDHLS<br>DGSSSMWLQPMMAALGLSSDARGCFTRD<br>SKGNVKEPAVALMSDFVGRKRELRMLLNF<br>PVDLDISKLEENIGKKARWEKQMNTAYEK<br>NKLKQRFHLIWPGMELKETQEPGQFWWD<br>NPTIQKEGMYCLAIDLSQRRAADYALLHA<br>GVNRDSKTFVELGQAGGQSWFTKLCAAGS<br>LRLPGEDTEVIREGKRQIELSGKKGRNATQ<br>SEYDQAIALAKQLLHNENSAELESAARDW<br>LGDNAKRFSFPEQNDKLIDLYYGALSRYKT<br>WLRWSWRLTEQHKELWDKTLDEIRKVPY<br>FASWGELAGNGTNEATVQQLQKLIADAAV<br>DLRNFLEKALLHIAYRALPLRENTWRWIEN<br>GKDGKGKPLHLLVSDGQSPAEIPWLRGQR<br>GLSIARIEQLENFRRAVLSLNRLLRHEIGTK<br>PEFGSSTCGESLPDPCPDLTDKIVRLKEERV<br>NQTAHLIIAQSLGVRLKGHSLFTEEREKAD<br>MHGEHEVIPGRSPVDFVVLEDLSRYTTDKS<br>RSRSENSRLMKWCHRKINEKVKLLAEPFGI<br>PVIEVFASYSSKFDARTGAPGFRAVEVTSE<br>DRPFWRKTIEKQSVAREVFDCLDNLVGKG<br>LNGIHLVLPQNGGPLFIAAVKEDQPLPAIRQ<br>ADINAAVNIGLRAIAGPSCYHAHPKVRLIK<br>GESGTDKGKWLPRKGKEANKRENAQFGN<br>VDLDLEVKFNRLDIDSDVLKGDNTNLFHD<br>PLNIACYGFATIQNLQHPFLAHASAVFSRQ<br>KGAVARLQWEVCRAINSRRLEAWQKKAE<br>KAAVKR |
| Opb (*Opitutaceae bacterium*) (SEQ ID NO: 531) | WP_0095 13281 | *Opitutaceae bacterium* | MSLNRIYQGRVAAVETGTALAKGNVEWM<br>PAAGGDEVLWQHHELFQAAINYYLVALLA<br>LADKNNPVLGPLISQMDNPQSPYHVWGSF<br>RRQGRQRTGLSQAVAPYITPGNNAPTLDEV<br>FRSILAGNPTDRATLDAALMQLLKACDGA<br>GAIQQEGRSYWPKFCDPDSTANFAGDPAM<br>LRREQHRLLLPQVLHDPAITHDSPALGSFD<br>TYSIATPDTRTPQLTGPKARARLEQAITLW<br>RVRLPESAADFDRLASSLKKIPDDDSRLNL<br>QGYVGSSAKGEVQARLFALLLFRHLERSSF<br>TLGLLRSATPPPKNAETPPPAGVPLPAASA |

TABLE 14-continued

| Name | Accession No. | Organism | Sequence |
|---|---|---|---|
| | | | ADPVRIARGKRSFVFRAFTSLPCWHGGDNI HPTWKSFDIAAFKYALTVINQIEEKTKERQ KECAELETDFDYMHGRLAKIPVKYTTGEA EPPPILANDLRIPLLRELLQNIKVDTALTDG EAVSYGLQRRTIRGFRELRRIWRGHAPAGT VFSSELKEKLAGELRQFQTDNSTTIGSVQLF NELIQNPKYWPIWQAPDVETARQWADAGF ADDPLAALVQEAELQEDIDALKAPVKLTP ADPEYSRRQYDFNAVSKFGAGSRSANRHE PGQTERGHNTFTTEIAARNAADGNRWRAT HVRIHYSAPRLLRDGLRRPDTDGNEALEAV PWLQPMMEALAPLPTLPQDLTGMPVFLMP DVTLSGERRILLNLPVTLEPAALVEQLGNA GRWQNQFFGSREDPFALRWPADGAVKTA KGKTHIPWHQDRDHFTVLGVDLGTRDAG ALALLNVTAQKPAKPVHRIIGEADGRTWY ASLADARMIRLPGEDARLFVRGKLVQEPY GERGRNASLLEWEDARNIILRLGQNPDELL GADPRRHSYPEINDKLLVALRRAQARLAR LQNRSWRLRDLAESDKALDEIHAERAGEK PSPLPPLARDDAIKSTDEALLSQRDIIRRSFV QIANLILPLRGRRWEWRPHVEVPDCHILAQ SDPGTDDTKRLVAGQRGISHERIEQIEELRR RCQSLNRALRHKPGERPVLGRPAKGEEIAD PCPALLEKINRLRDQRVDQTAHAILAAALG VRLRAPSKDRAERRHRDIHGEYERFRAPA DFVVIENLSRYLSSQDRARSENTRLMQWC HRQIVQKLRQLCETYGIPVLAVPAAYSSRF SSRDGSAGFRAVHLTPDHRHRMPWSRILA RLKAHEEDGKRLEKTVLDEARAVRGLFDR LDRFNAGHVPGKPWRTLLAPLPGGPVFVP LGDATPMQADLNAAINIALRGIAAPDRHDI HHRLRAENKKRILSLRLGTQREKARWPGG APAVTLSTPNNGASPEDSDALPERVSNLFV DIAGVANFERVTIEGVSQKFATGRGLWAS VKQRAWNRVARLNETVTDNNRNEEEDDIP M |
| Phyci (*Phycisphaerae bacterium*) (SEQ ID NO: 532) | AQT6968 5 | *Phycisphaerae bacterium* | MATKSYRARILTDSRLAAALDRTHVVFVE SLKQMINTYLRMQNGKFGPDHKKLAQIML SRSNTFAHGVMDQITRDQPTSTLDEEWTDL ARRIHKTTGPLFLQAERFATVKNRAIHTKS RGKVIPSPETLAVPAKFWHQVCDSASAYIR SNRELMQQWRKDRAAWLKDKNEWQQKH PEFMQFYNGPYQNFLKLCDDDRITSQLAAE QQPTASKNNRPRKTGKRFARWHLWYKWL SENPEIIEWRNKASASDFKTVTDDVRKQIIT KYPQQNKYITRLLDWLEDNNPELKTLENL RRTYVKKFDSFKRPPTLTLPSPYRHPYWFT MELDQFYKKADFENGTIQLLLIDEDDDGN WFFNWMPASLKPDPRLVPSWRAETFETEG RFPPYLGGKIGKKLSRPAPTDAERKAGIAG AKLMIKNNRSELLFTVFEQDCPPRVKWAK TKNRKCPADNAFSSDGKTRKPLRILSIDLGI RHIGAFALTQGTRNDSAWQTESLKKGIINS PSIPPLRQVRRHDYDLKRKRRRHGKPVKG QRSNANLQAHRTNMAQDRFKKGASAIVSL AREHSADLILFENLHSLKFSAFDERWMNRQ LRDMNRRHIVELVSEQAPEFGITVKDDINP WMTSRICSNCNLPGFRFSMKKKNPYREKL PREKCTDFGYPVWEPGGHLFRCPHCDHRV NADINAAANLANKFFGLGYWNNGLKYDA ETKTFTVHTDKKTPPLIFKPRPQFDLWADS VKTRKQLGPDPF |
| Planc (*Planctomycetes bacterium*) (SEQ ID NO: 533) | OHB6217 5 | *Planctomycetes bacterium* | MSVRSFQARVECDKQTMEHLWRTHKVFN ERLPEIIKILFKMKRGECGQNDKQKSLYKSI SQSILEANAQNADYLLNSVSIKGWKPGTAK KYRNASFTWADDAAKLSSQGIHVYDKKQ VLGDLPGMMSQMVCRQSVEAISGHIELTK KWEKEHNEWLKEKEKWESEDEHKKYLDL REKFEQFEQSIGGKITKRRGRWHLYLKWLS DNPDFAAWRGNKAVINPLSEKAQIRINKAK PNKKNSVERDEFFKANPEMKALDNLHGYY ERNFVRRRKTKKNPDGFDHKPTFTLPHPTI HPRWFVFNKPKTNPEGYRKLILPKKAGDL GSLEMRLLTGEKNKGNYPDDWISVKFKAD |

TABLE 14-continued

| Name | Accession No. | Organism | Sequence |
|---|---|---|---|
| | | | PRLSLIRPVKGRRVVRKGKEQGQTKETDSY EFFDKHLKKWRPAKLSGVKLIFPDKTPKAA YLYFTCDIPDEPLTETAKKIQWLETGDVTK KGKKRKKKVLPHGLVSCAVDLSMRRGTT GFATLCRYENGKIHILRSRNLWVGYKEGK GCHPYRWTEGPDLGHIAKHKREIRILRSKR GKPVKGEESHIDLQKHIDYMGEDRFKKAA RTIVNFALNTENAASKNGFYPRADVLLLEN LEGLIPDAEKERGINRALAGWNRRHLVER VIEMAKDAGFKRRVFEIPPYGTSQVCSKCG ALGRRYSIIRENNRREIRFGYVEKLFACPNC GYCANADHNASVNLNRRFLIEDSFKSYYD WKRLSEKKQKEEIETIESKLMDKLCAMHKI SRGSISK |
| Sb (*Spirochaetes bacterium*) (SEQ ID NO: 534) | OHD1600 8 | *Spirochaetes bacterium* | MSFTISYPFKLIIKNKDEAKALLDTHQYMN EGVKYYLEKLLMFRQEKIFIGEDETGKRIYI EETEYKKQIEEFYLIKKTELGRNLTLTLDEF KTLMRELYICLVSSSMENKKGFPNAQQASL NIFSPLFDAESKGYILKEENNNISLIHKDYG KILLKRLRDNNLIPIFTKFTDIKKITAKLSPT ALDRMIFAQAIEKLLSYESWCKLMIKERFD KEVKIKELENKCENKQERDKIFEILEKYEEE RQKTFEQDSGFAKKGKFYITGRMLKGFDEI KEKWLKEKDRSEQNLINILNKYQTDNSKL VGDRNLFEFIIKLENQCLWNGDIDYLKIKR DINKNQIWLDRPEMPRFTMPDFKKHPLWY RYEDPSNSNFRNYKIEVVKDENYITIPLITE RNNEYFEENYTFNLAKLKKLSENITFIPKSK NKEFEFIDSNDEEEDKKDQKKSKQYIKYCD TAKNTSYGKSGGIRLYFNRNELENYKDGK KMDSYTVFTLSIRDYKSLFAKEKLQPQIFN TVDNKITSLKIQKKFGNEEQTNFLSYFTQN QITKKDWMDEKTFQNVKELNEGIRVLSVD LGQRFFAAVSCFEIMSEIDNNKLFFNLNDQ NHKIIRINDKNYYAKHIYSKTIKLSGEDDDL YKERKINKNYKLSYQERKNKIGIFTRQINK LNQLLKIIRNDEIDKEKFKELIETTKRYVKN TYNDGIIDWNNVDNKILSYENKEDVINLHK ELDKKLEIDFKEFIRECRKPIFRSGGLSMQRI DFLEKLNKLKRKWVARTQKSAESIVLTPKF GYKLKEHINELKDNRVKQGVNYILMTALG YIKDNEIKNDSKKKQKEDWVKKNRACQIIL MEKLTEYTFAEDRPREENSKLRMWSHRQI FNFLQQKASLWGILVGDVFAPYTSKCLSDN NAPGIRCHQVTKKDLIDNSWFLKIVVKDD AFCDLIEINKENVKNKSIKINDILPLRGGELF ASIKDGKLHIVQADINASRNIAKRFLSQINP FRVVLKKDKDETFHLKNEPNYLKNYYSIL NFVPTNEELTFFKVEENKDIKPTKRIKMDK HEKESTDEGDDYSKNQIALFRDDSGIFFDK SLWVDGKIFWSVVKNKMTKLLRERNNKK NGSK |
| Vb (*Verrucomicrobiaceae bacterium*) (SEQ ID NO: 535) | | *Verrucomicrobiaceae bacterium* | MPLSRIYQGRTNSLIILTPTPQEPWDHKALA RFDSPLWRHHALFQDAVNYYQLCLVALAS SDGTRPLSKLHEQMKASWDEAKTDTEDS WRVRLARRLGIPAASLFEAALAKVLEGNE APERARELAGELLLDKIEGDIQQAGRGYWP RFCDPKANPTYDYSATARASASGLTKLAA VIHAENVTEEALKQVAAEMDLSWTVKLQP DKNFVGAEARARLLEAAHHFIKVAESPPTK LAEVLARFPDGLALWQALPEKIAALPEETQ VPRNRKASPDLTFATLLFQHFPSLFTAAVL GLSVGKPKSVKAPKVVEKVSARRKANAVT QAVVIEEPEIDFAELGDDPIKLARGERGFVF PAFTSLSFWAVPGPHVPVWKEFDIAAFKEA LKTVNQFKLKTSERNALLAEAQRRLDYMD EKTHDWKTGDSDEPGHIPPRLKSDPNFTLI QALTQDEGVSNKATGDQHIPKGVYTGGLR GFYAIKKDWCELWERKADKSQGTPTEEELI SIVTDYQRDHVYDVGDVGLFRALCEPRFW PLWQPLTDEQEAERIKAGRAKDMISAYRV WLELQEDVVRLAQPIRFTPAHAENSRRLFM FSDISGSHGAEFGSDGKSLEVSIAYDVDGK LQPVRAKLEFSAPRAARDELEGLSGGSESM RWFQPMMKALDCPEVEMPALEKCAVSLM |

TABLE 14-continued

| Name | Accession No. | Organism | Sequence |
|---|---|---|---|
| | | | PDVVKKGGGKWVRLLLNFPATLEPEGLIRHIGKQAMWYKQFNGTYKPRTQQLDTGLHLYWPGLEKAPEAEDAAAWWNREEIRAKGFSVLSVDLGQRDAGAWALLESRSDKAFSRNRQPFIELGEAGGKLWSTALLGLGMLRLPGEDARTGALDDQGKRAVEFHGKAGRNALEAEWQEAREMALLFGGEEAKSRLGPGFDHLSHSKQNEELLRILSRAQSRLARFHRWSCRIHEKPEATGDDVIDYGQVDELLTKTAEAMLENLKALYTNAGGILDSKSKQPLTLVGLRKKLEAQKVEPEKIAAVLKPHAEIIFQRLGTLIPELKQHLRVSLERLANRELPLRHREWVWNEAFEKLEQGNFKKEENPKWIRGQRGLSMARIEQIENLRKRFMSLRRQMSLIPGEQVKQGVEDKGQRQPEPCEDILNKLDRMKQQRVNQTAHLILAQALGLRLRPHLANDAEREEKDIHGEYELIPGRKPVDFIVMEDLSRYLSSQGRAPSENGRLMKWCHRAVLAKLKQMCEPFGIPVLEVPAAYSSRFCALTGVPGFRAVEVHDGNAEDFRWKRLIKKAEKDKSSKDAEAAAMLFDQLHDLNIEAREARKQDKKLPLRTLFAPVAGGPLFIPMVGGGPRQADMNAAINLGLRAIASPTCLRARPKIRAELKDGKHQAMLGNKLEKAAALTLEPPKEPTKELAAQKRTNFFLDEKFVGKFDTAHVTTSGKKLRLSGGMSLWKAIKDGAWQRVKKINDARIAKWKNNPPPEPDPDDEIQF |

Figure 15A:
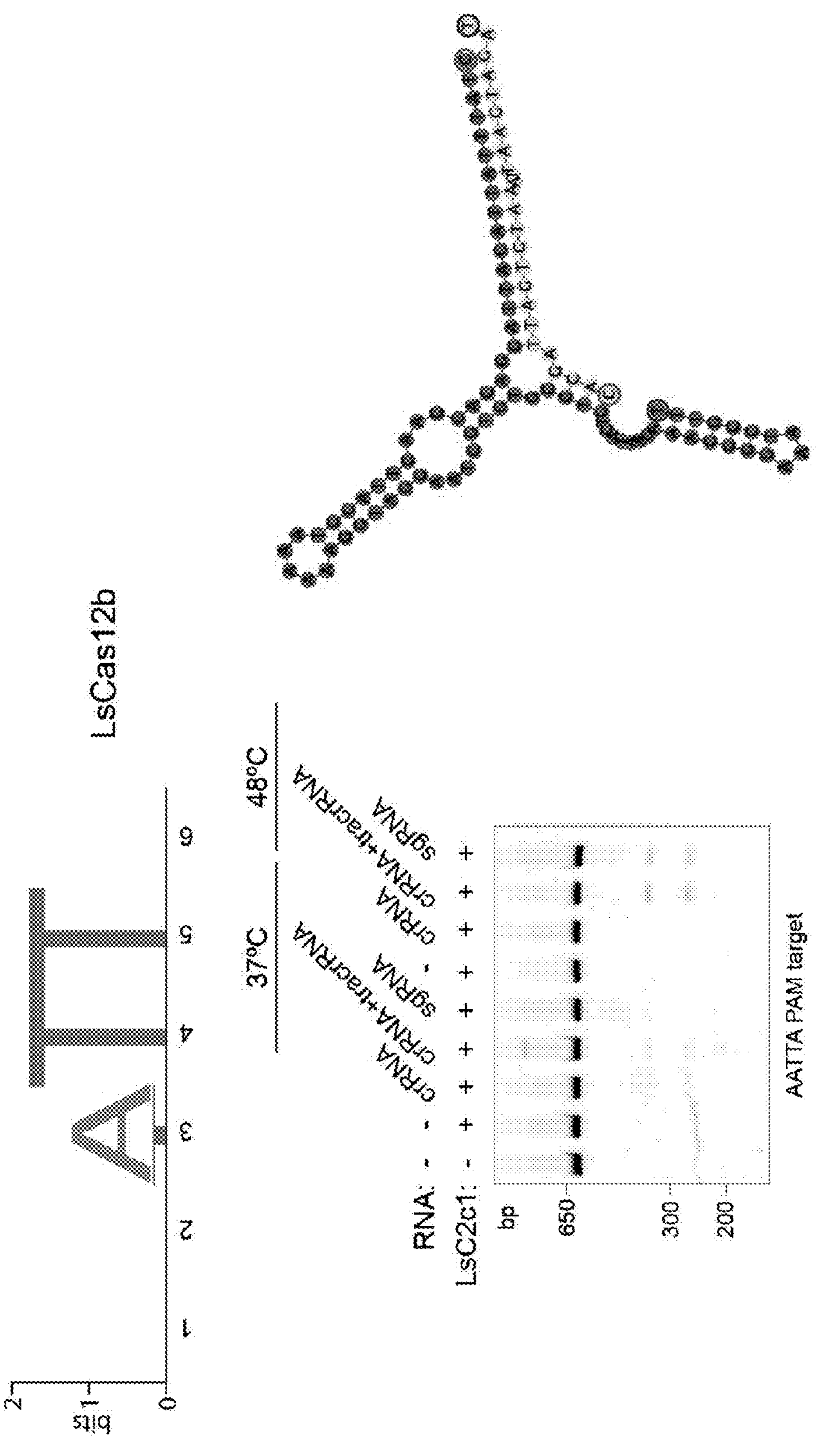
FIGS. 15A-15C show PAM discovery, in vitro cleavage with purified protein and RNA using Cas12b orthologs from Ls, Ak, and Bv, respectively.
Figure 15B:
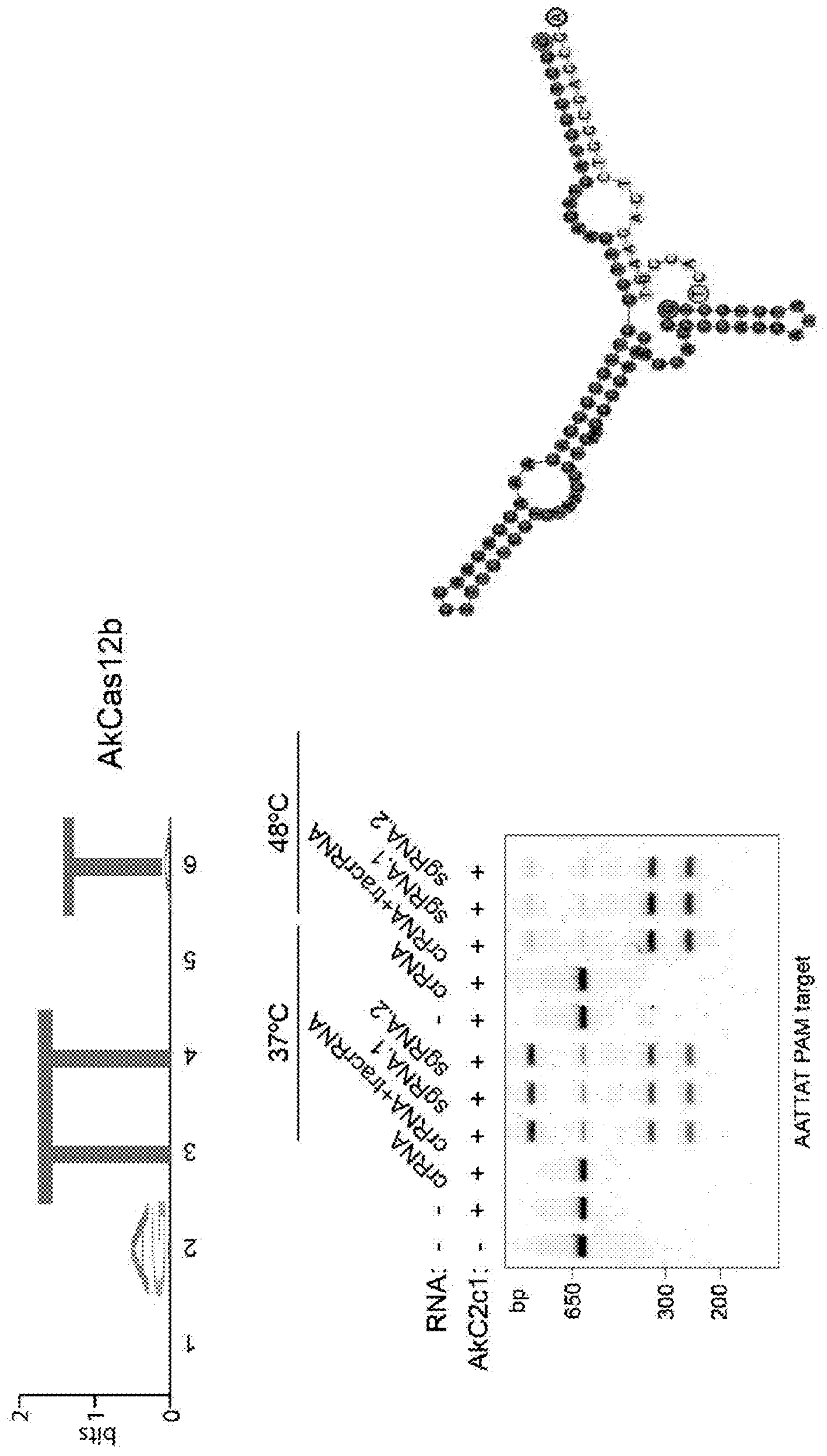
Figure 15C:
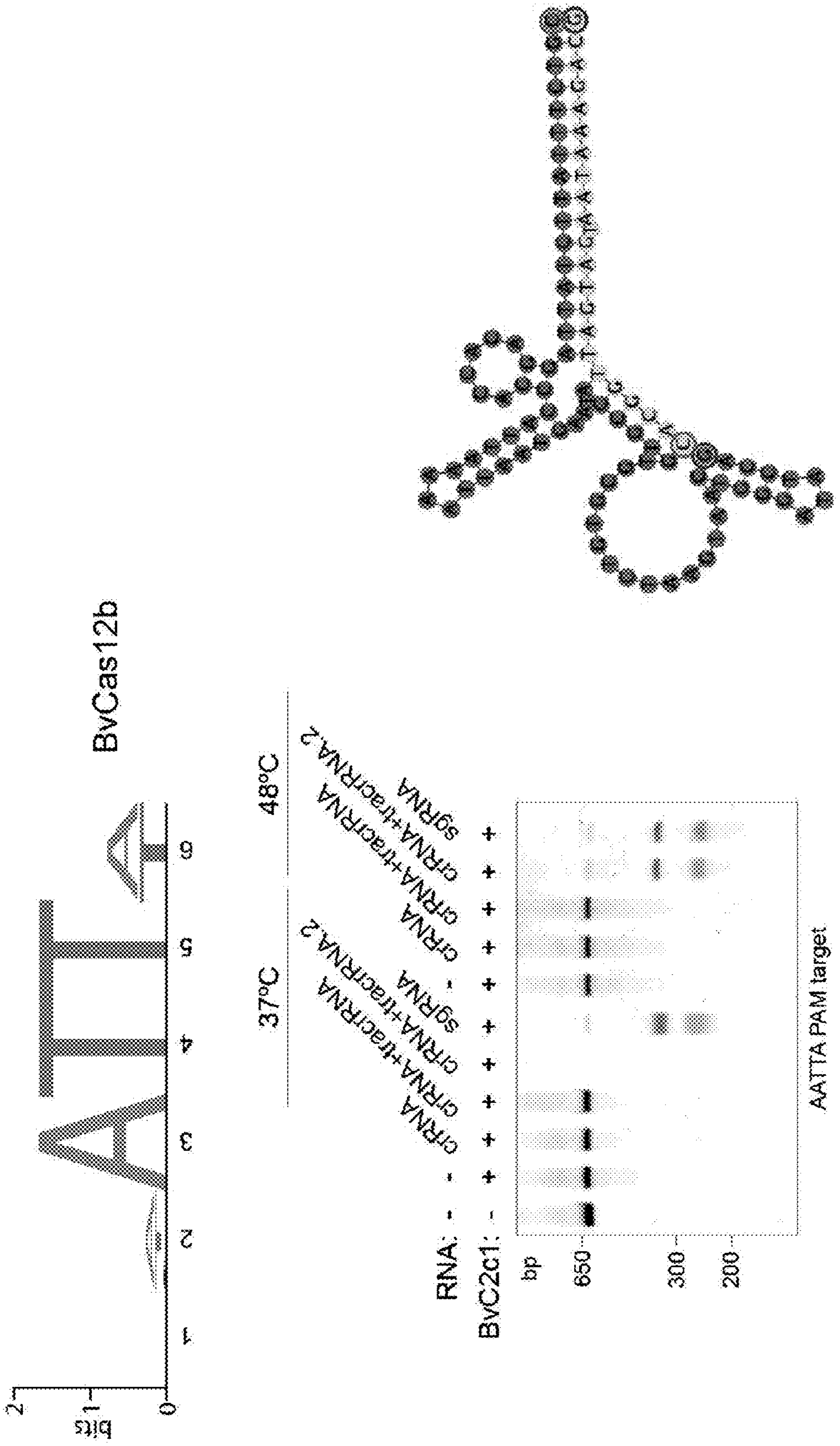
Figure 15D:
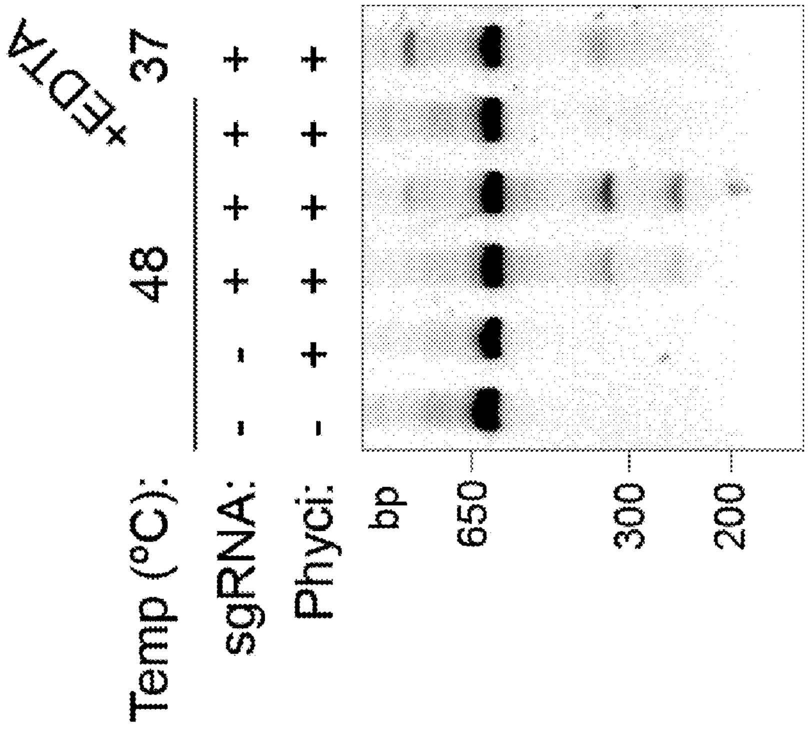
FIGS. 15D-15E show in vitro cleavage with purified protein and RNA using Cas12B orthologs from Phyci and Planc, respectively.
Figure 15E:
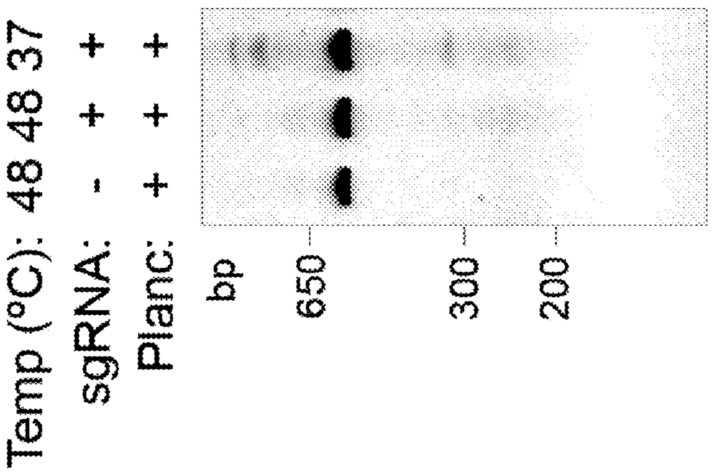

Table 15 shows exemplary sequences of crRNA, tracrRNA, and sgRNA for Cas12b orthologs of Ls, Ak, Bv, Phyci, and Planc shown in Table 14. FIGS. 15A-15C show PAM discovery, in vitro cleavage with purified protein and RNA using Cas12b orthologs in Ls, Ak, and Bv, respectively. FIGS. 15D-15E show in vitro cleavage with purified protein and RNA using Cas12B orthologs of Phyci and Planc, respectively.

TABLE 15

| Name | crRNA | tracrRNA | sgRNA |
|---|---|---|---|
| Ls | UAGAUGAAUUAAAUGUGAUUAGCAC (SEQ ID NO: 536) | UUUGCCUAAAGGGCAAAGAAUACUGUGCGUGUGCUAAGGAUGGAAAAAAUCCAUUCAACCACAGGAUUACAUUAUUUAUC (SEQ ID NO: 537) | UUUGCCUAAAGGGCAAAGAAUACUGUGCGUGUGCUAAGGAUGGAAAAAAUCCAUUCAACCACAGGAUUACAUUAUUUAUCAAAAGAUGAAUAAUGUGAUUAGCAC (SEQ ID NO: 538) |
| Ak | AGCGAGCGGUCUGAGAAGUGGCACU (SEQ ID NO: 539) | GUCGUCUAUAGGACGGCGAGGACAACGGGAAGUGCCAAUGUGCUCUUUCCAAGAGCAAACACCCCGUUGGCUUCAAGAUGACCGCUCGC (SEQ ID NO: 540) | GUCGUCUAUAGGACGGCGAGGACAACGGGAAGUGCCAAUGUGCUCUUUCCAAGAGCAAACACCCCGUUGGCUUCUCAGACCGCUCGAAAACGAGCGGUCUGAGAAGUGGCACU (SEQ ID NO: 541) |
| Bv | GCAGAAAUAAUGAUGAUUGGCAC (SEQ ID NO: 542) | GACCUAUAGGGUCAAUGAAUCUGUGCGUGUGCCAUAAGUAAUUAAAAAUUACCCACCACAGGAUUAUCUUAUUUCUGC (SEQ ID NO: 543) | GACCUAUAGGGUCAAUGAAUCUGUGCGUGUGCCAUAAGUAAUUAAAAAUUACCCACCACAGGAUUAUCUUAUUUCUGCAAAAGCAGAAAUAAGAUGAUUGGCAC (SEQ ID NO:544) |

TABLE 15-continued

| Name | crRNA | tracrRNA | sgRNA |
|---|---|---|---|
| Phyci | | | UCAGCCAACAUGCUCGCUUUGCGAAGGCUGACGGCCCGCUCUCAUUUGGCAUUGCCGGGAGCCGGAGUUUUCGGAAGAGAGUGUCGACGACUGCUGAUCUCCGCAUCCGCGUCCUGUUCGCCAGGCCGGGUCGGGUGUACGGAUCAUGCUGGCAGCAGUCUACGCCGAGAACAUUCGCUACCGCGAAUGGACAC (SEQ ID NO: 545) |
| Planc | | | GUGGAGUAAGGUCGGAGUAACGACCGAACGUUUAGCGUGCUAUAGGCCGCUGAAUGCCACACAGCGAUGUGUUUUGAGUGUCAAUAGCUGCUGACCCAAAGGCCAAAAGCCGAGUAGGGCUUGACUGAUGCGGUUUAUAUCGCACAUAGGCGGCAGUAACACAUAUCGCGUCAAUCAAAUUUAUUGAUGGACAC (SEQ ID NO: 546) |

Example 7

Exemplary direct repeat sequences, crRNA sequences, tracrRNA sequences, and sgRNAs for *Alicyclobacillus macrosporangiidus* Cas12b are shown in Table 16 below.

TABLE 16

| Am Cas12b direct repeat sequences | |
|---|---|
| 21nt | GGGCGAUCUGAGAAGUGGCAC (SEQ ID NO: 547) |
| 29nt | CGUUGAGCGGGCGAUCUGAGAAGUGGCAC (SEQ ID NO: 548) |
| Full-length | GUCGGAUCGUUGAGCGGGCGAUCUGAGAAGUG GCAC (SEQ ID NO: 549) |
| **crRNA** | |
| nC1523 (21 nt DR + 23nt guide) | CGAUCUGAGAAGUGGCACGAGAAGUCAUUUAA TAAGGCCAC (SEQ ID NO: 550) |
| **tracr RNA** | |
| nC1518 | CCGAUCUAUAGGACGGCAGAUUCAACGGGAUG (SEQ ID NO: 551) |
| nC1519 | CCGAUCUAUAGGACGGCAGAUUCAACGGGAUG UGCCAA (SEQ ID NO: 552) |
| nC1520 | CCGAUCUAUAGGACGGCAGAUUCAACGGGAUG UGCCAAUGCACUCUUUCCAGGAGUGAACA (SEQ ID NO: 553) |
| nC1521 | CCGAUCUAUAGGACGGCAGAUUCAACGGGAUG UGCCAAUGCACUCUUUCCAGGAGUGAACACCC CGUUGGCUUCAACAUGAUCGCCCGCUCAACGG U (SEQ ID NO: 554) |
| nC1522 | UGCCAAUGCACUCUUUCCAGGAGUGAACACCC CGUUGGCUUCAACAUGAUCGCCCGCUC (SEQ ID NO: 555) |
| **sgRNAs** | |
| sgRNA 1 full tracr-CTA loop-full DR | GCCGAUCUAUAGGACGGCAGAUUCAACGGGAUG UGCCAAUGCACUCUUUCCAGGAGUGAACACCCC GUUGGCUUCAACAUGAUCGCCCGCUCAACGGUC CCUAGUCGGAUCGUUGAGCGGGCGAUCUGAGAA GUGGCAC (SEQ ID NO: 556) |
| sgRNA2 96nt tracr-CTA loop-29nt DR | GCCGAUCUAUAGGACGGCAGAUUCAACGGGAUG UGCCAAUGCACUCUUUCCAGGAGUGAACACCCC GUUGGCUUCAACAUGAUCGCCCGCUCAACGCUA CGUUGAGCGGGCGAUCUGAGAAGUGGCAC (SEQ ID NO: 557) |
| sgRNA3 88nt tracr-CTA loop-21nt DR | GCCGAUCUAUAGGACGGCAGAUUCAACGGGAU GUGCCAAUGCACUCUUUCCAGGAGUGAACACC CCGUUGGCUUCAACAUGAUCGCCCCUAGGGCG AUCUGAGAAGUGGCAC (SEQ ID NO: 558) |

Figure 16:
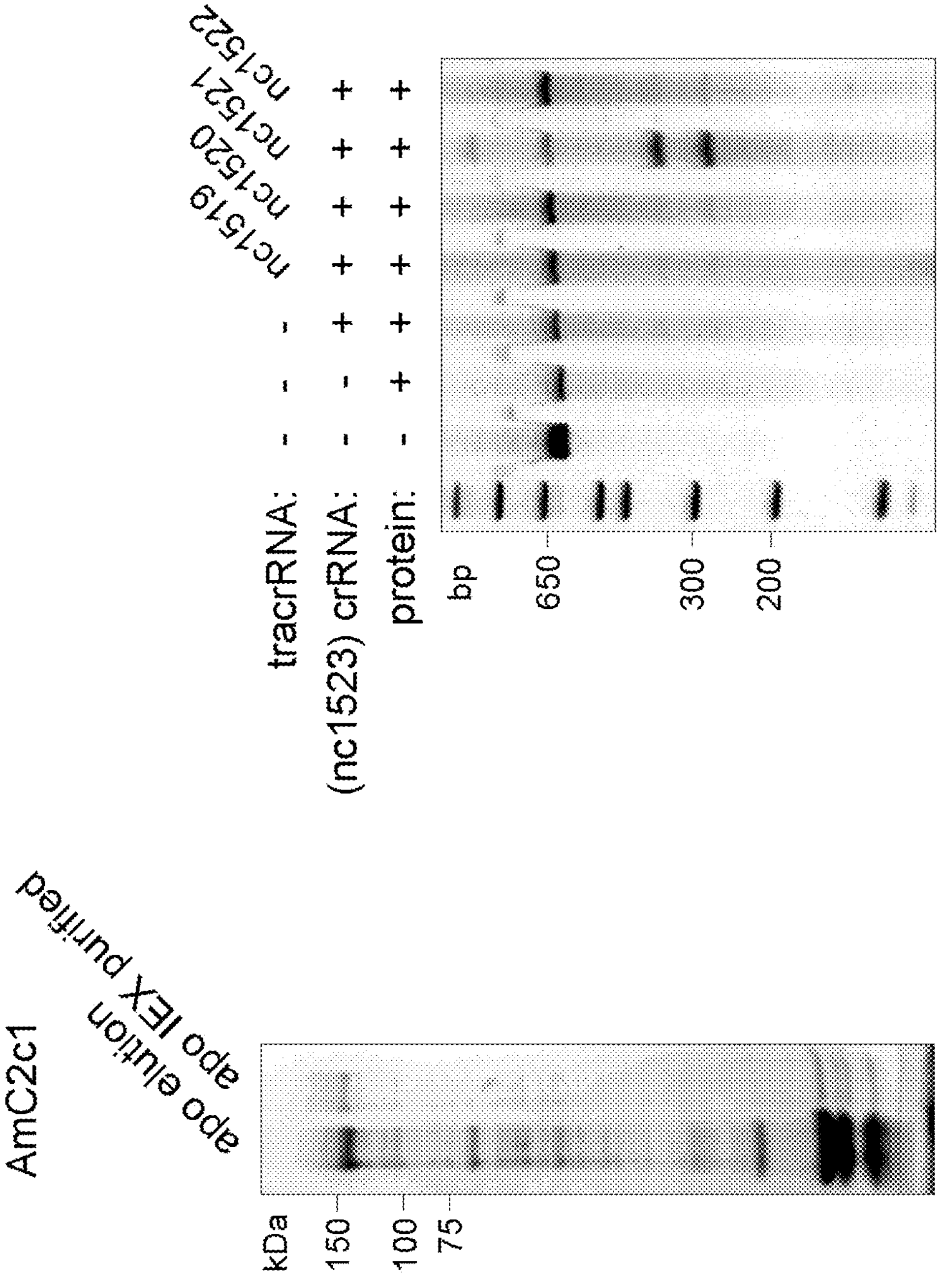
FIG. 16 shows purified AmCas12b (AmC2C1) protein and in vitro cleavage assay with different predicted tracr RNAs from small RNAseq.

FIG. 16 shows purified AmCas12b (AmC2C1) protein and in vitro cleavage assay with different predicted tracr RNAs from small RNAseq. We used a TTTA PAM since TTA is the consensus PAM for C2C1 at this point.

Figure 17A:
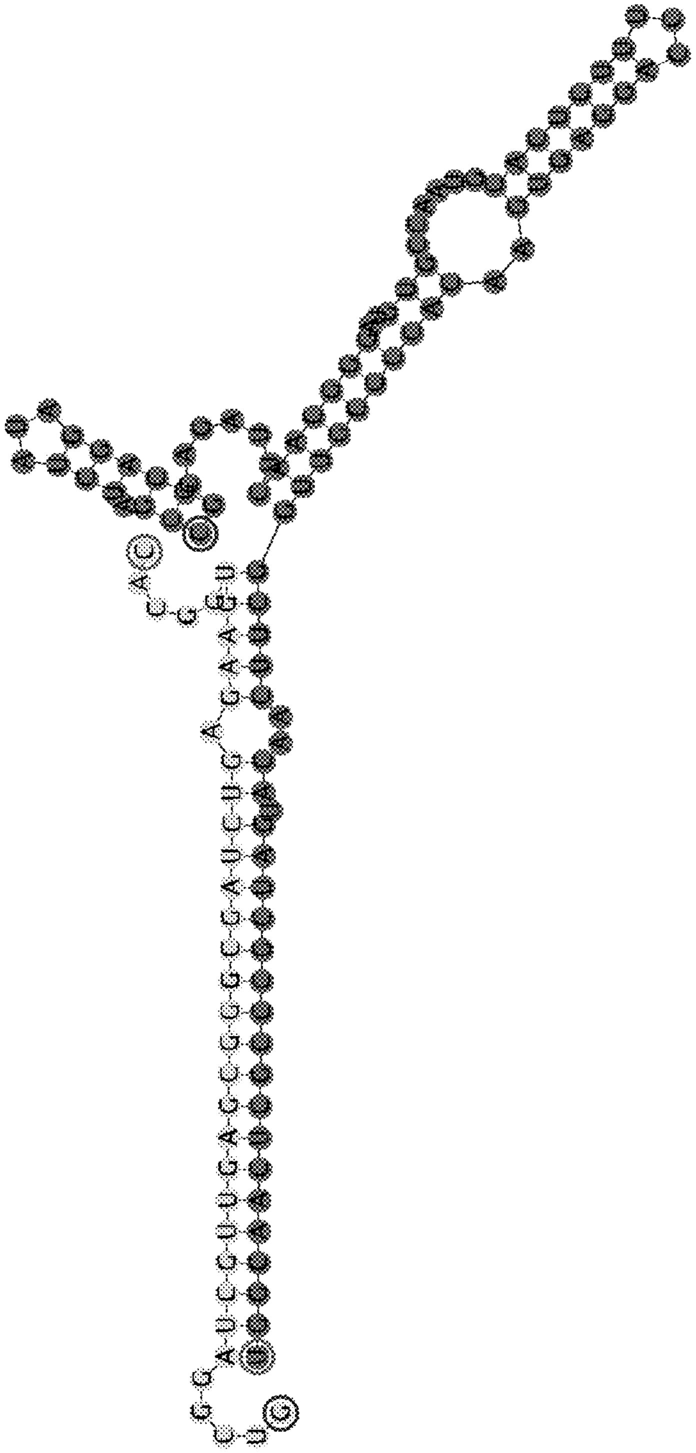
FIGS. 17A-17E show sgRNA designs for AmC2C1.
Figure 17B:
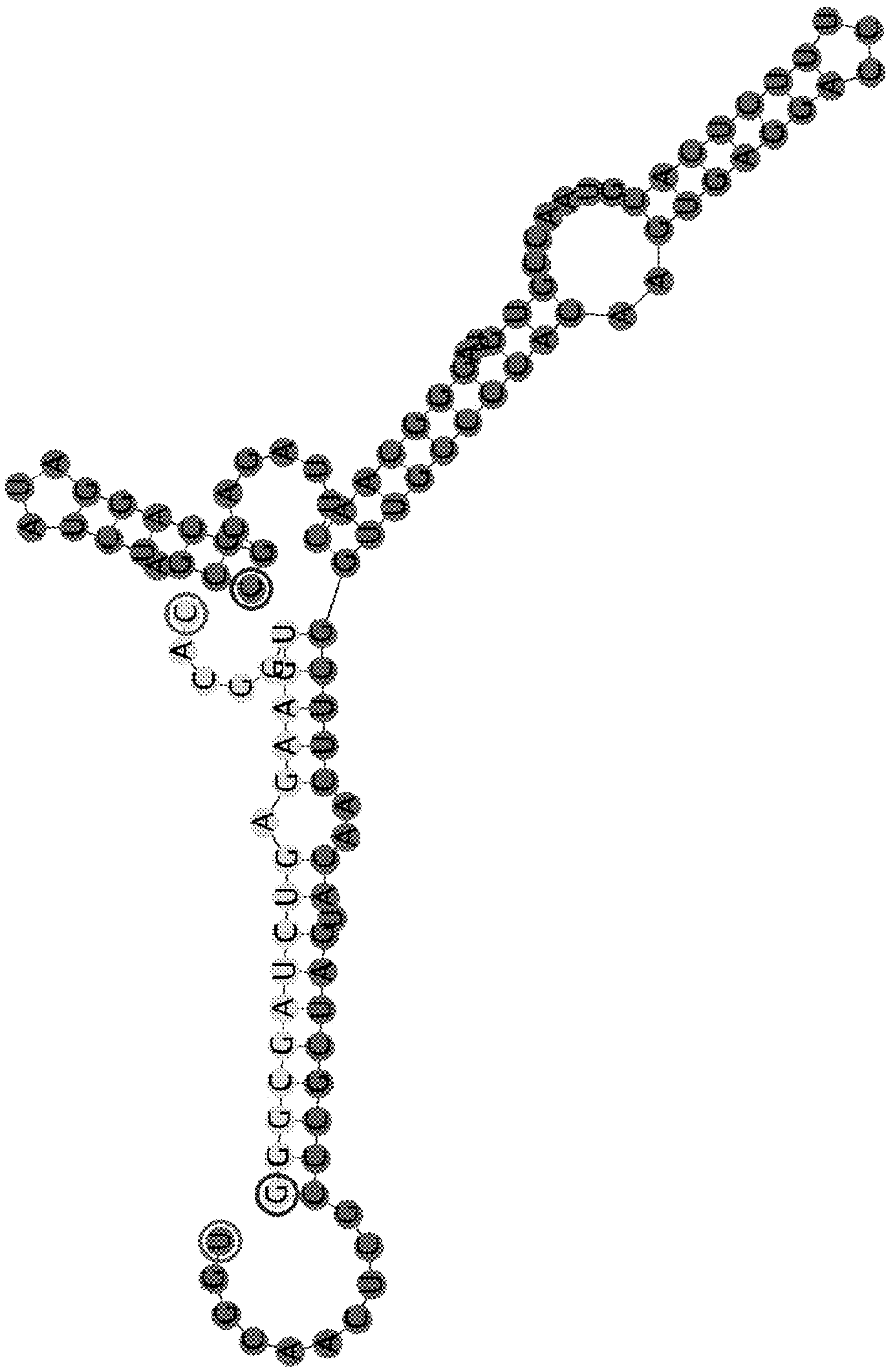
Figure 17C:
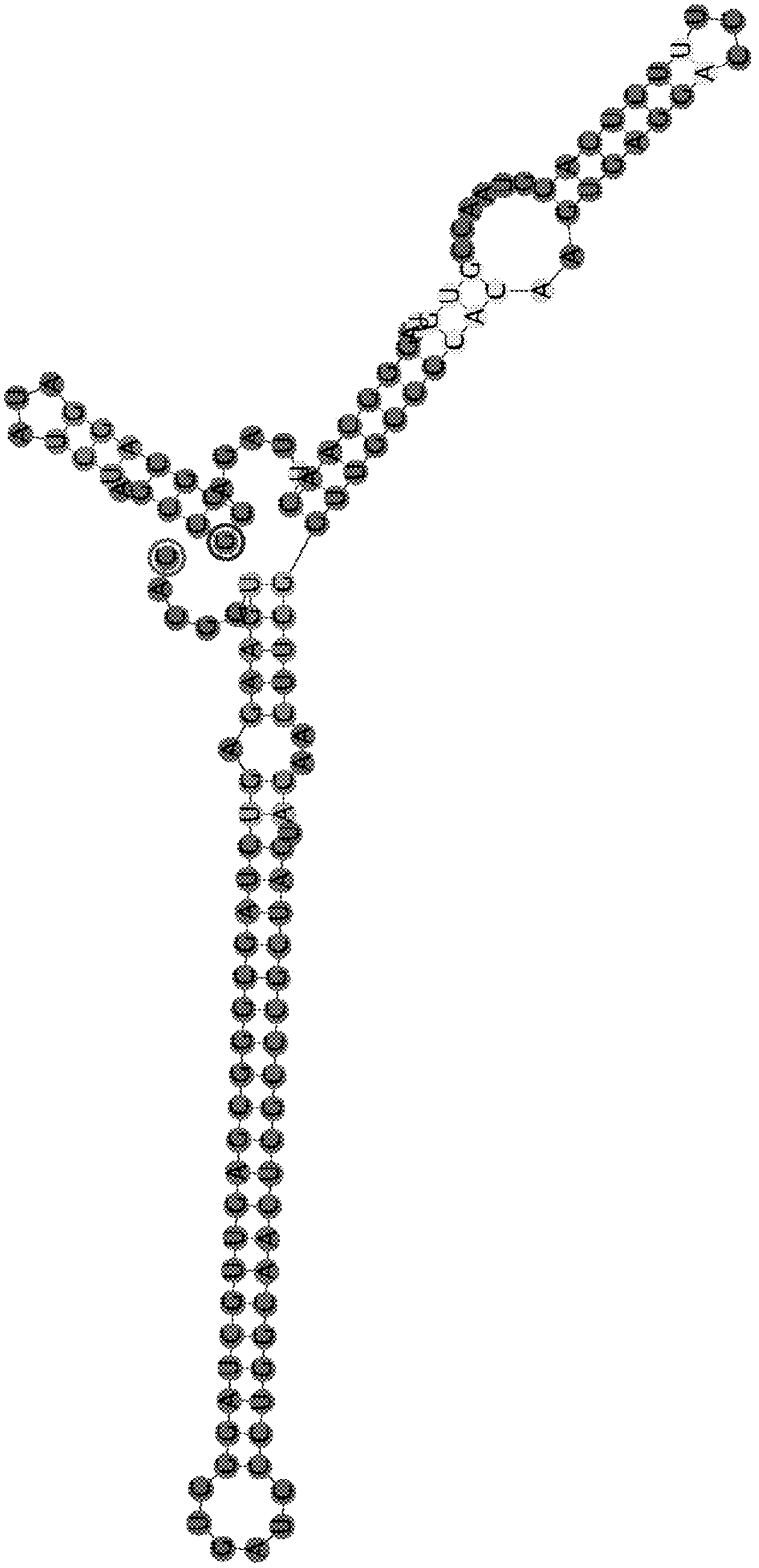
Figure 17D:
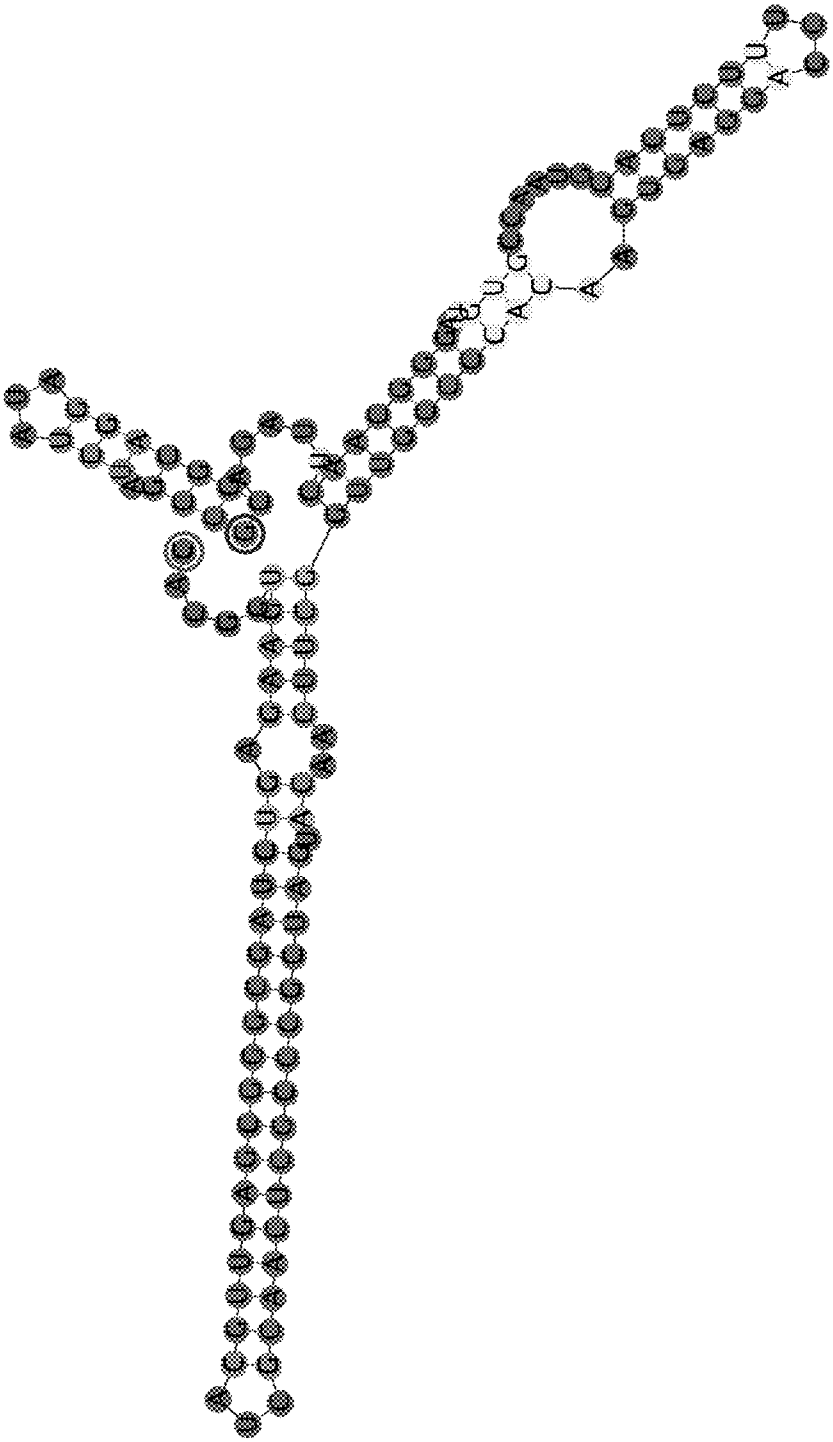
Figure 17E:
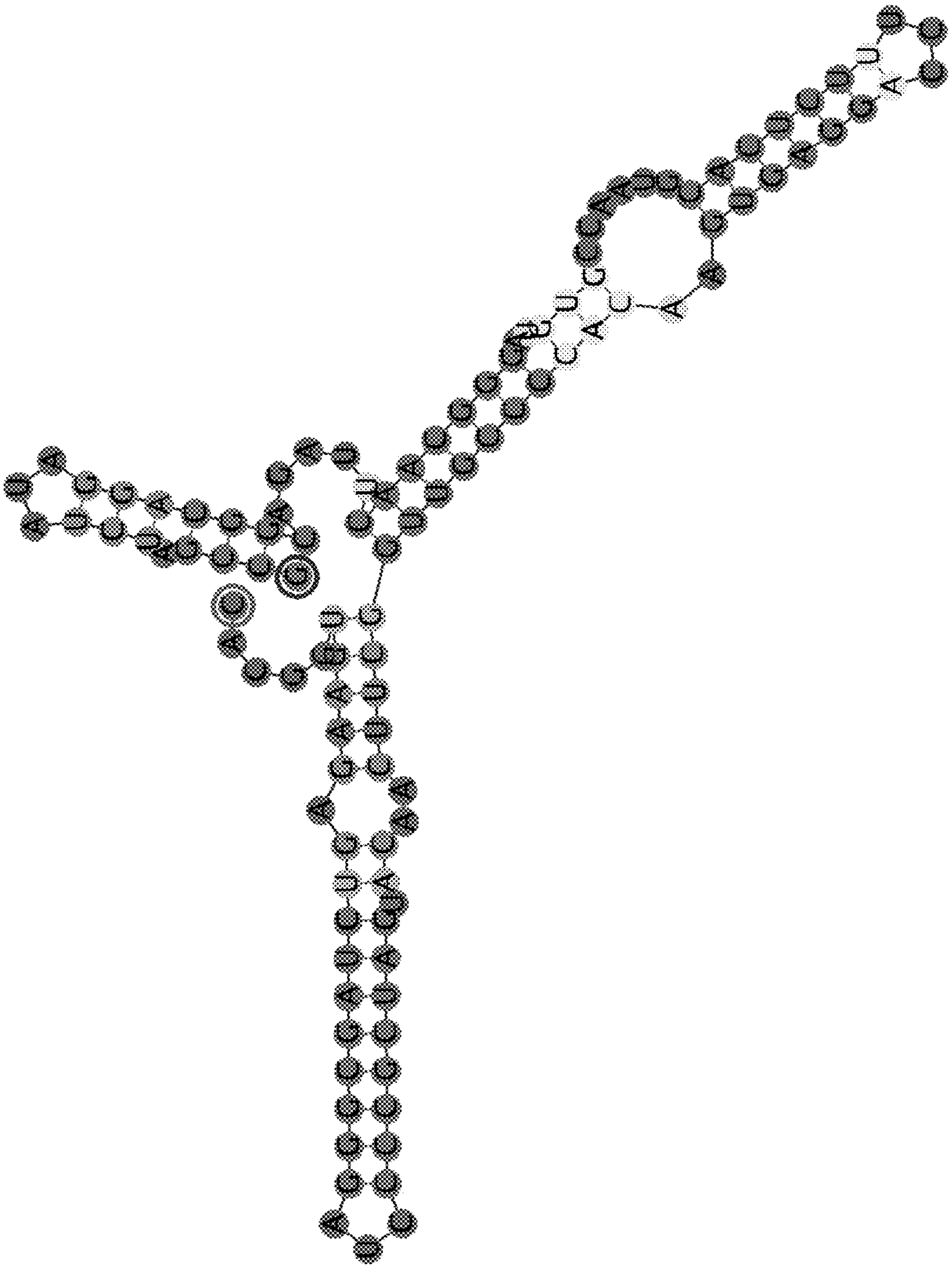

Various sgRNA designs are shown in FIGS. 17A-17E. FIG. 17A shows full-length AmC2C1 direct repeat sequence (green) annealed to tracr RNA (red). Tracr was predicted by small RNAseq and confirmed in vitro. Blue circle=5' end; red circle=3' end. FIG. 17B shows 21nt of AmC2C1 direct repeat sequence (green) annealed to tracr RNA (red). Tracr was predicted by small RNAseq and confirmed in vitro. Blue circle=5' end; red circle=3' end. FIG. 17C shows fusion of full length direct repeat and tracr with CTA loop. FIG. 17D shows 29nt of direct repeat and tracr with CTA loop. FIG. 17E shows 21nt of direct repeat and tracr with CTA loop.

Figure 18:
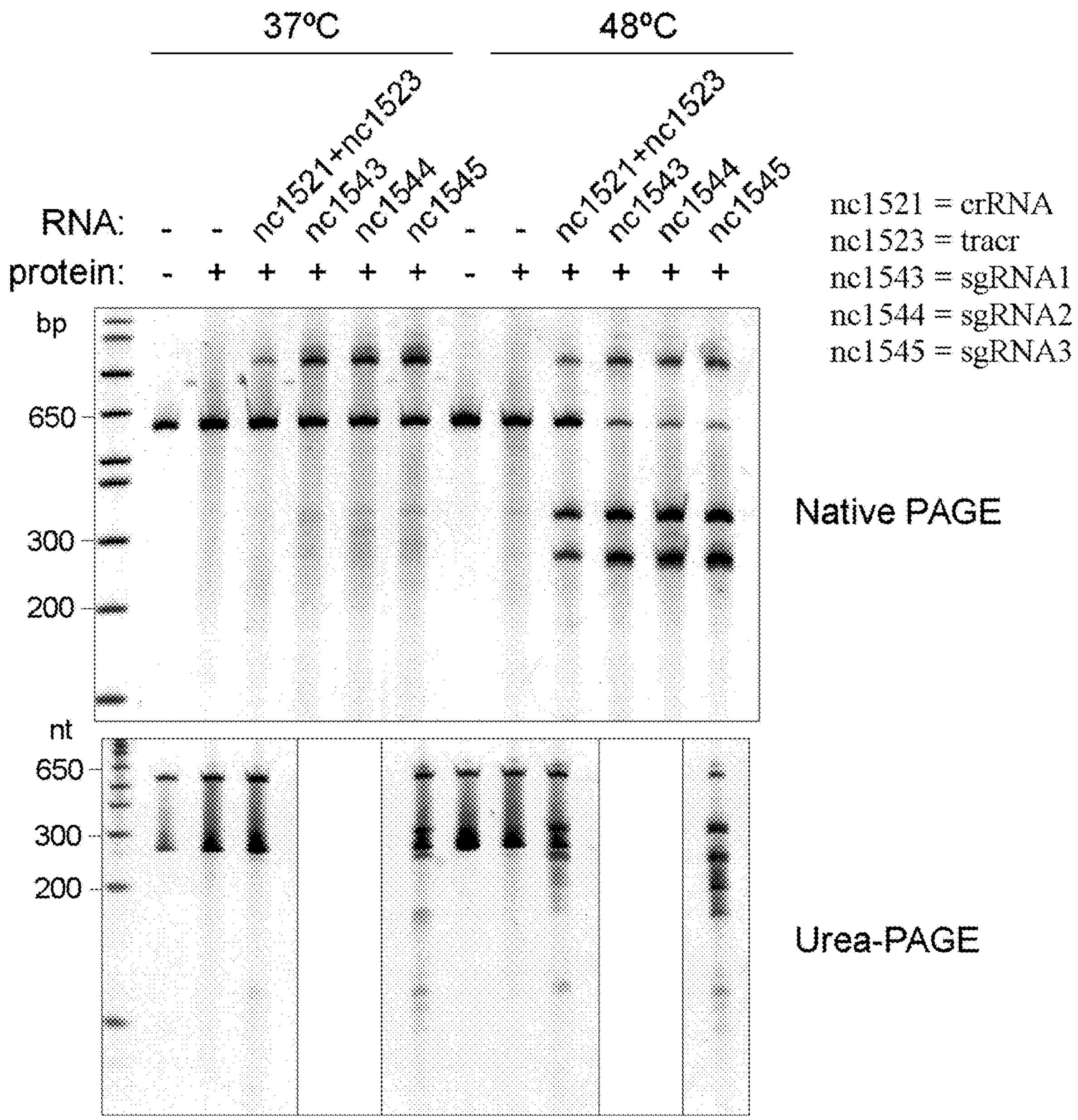
FIG. 18 shows in vitro cleavage with AmC2C1 for comparison of sgRNA efficiencies.

FIG. 18 shows in vitro cleavage with AmC2C1 for comparison of sgRNA efficiencies.

Figure 19:
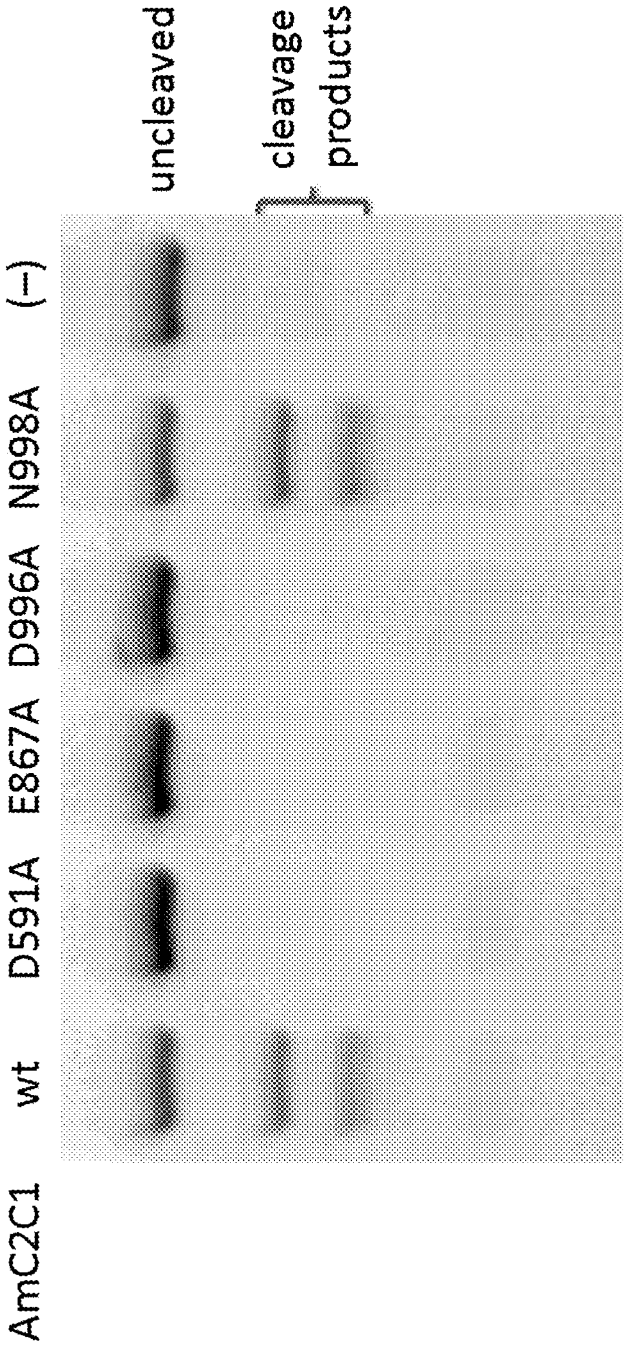
FIG. 19 shows activities of AmC2C1 RuvC mutants.
Figure 20A:
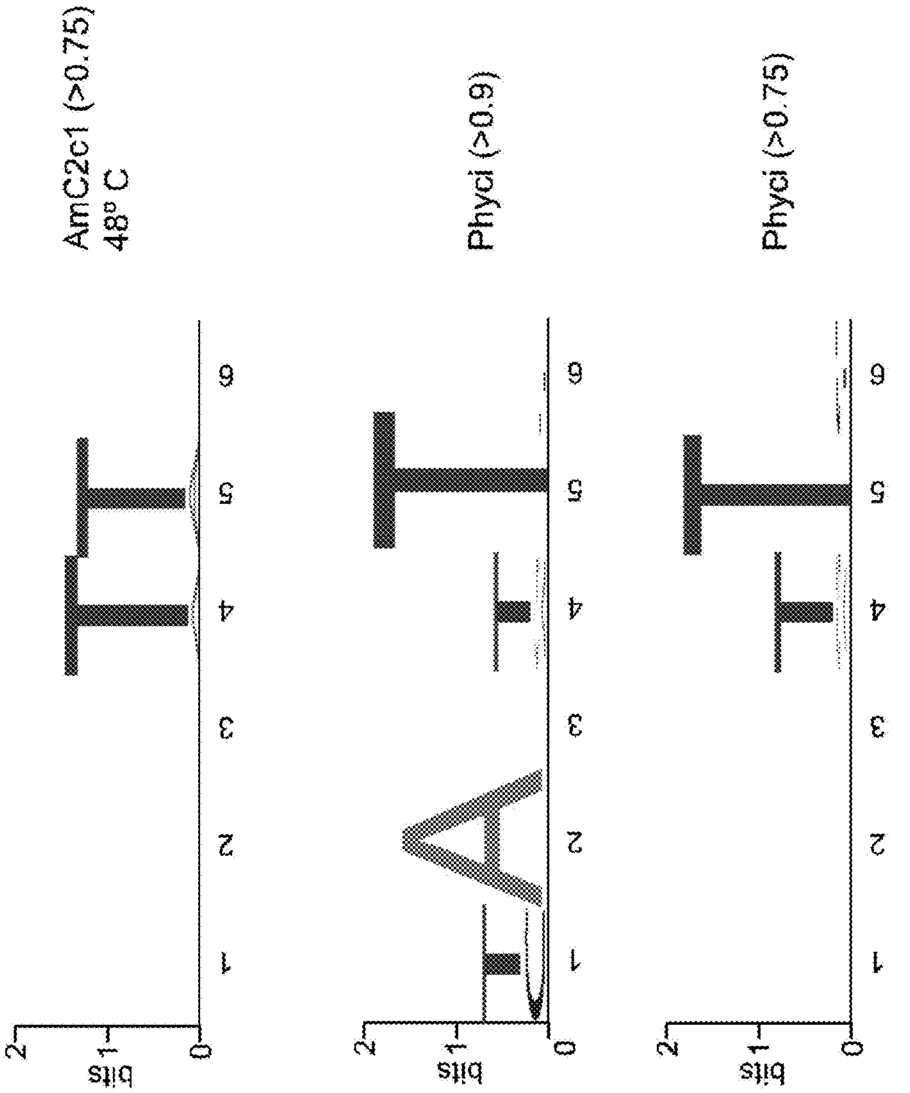
FIGS. 20A-20B shows determination of PAMs for Cas12b orthologs by an in vitro PAM screen.
Figure 20B:
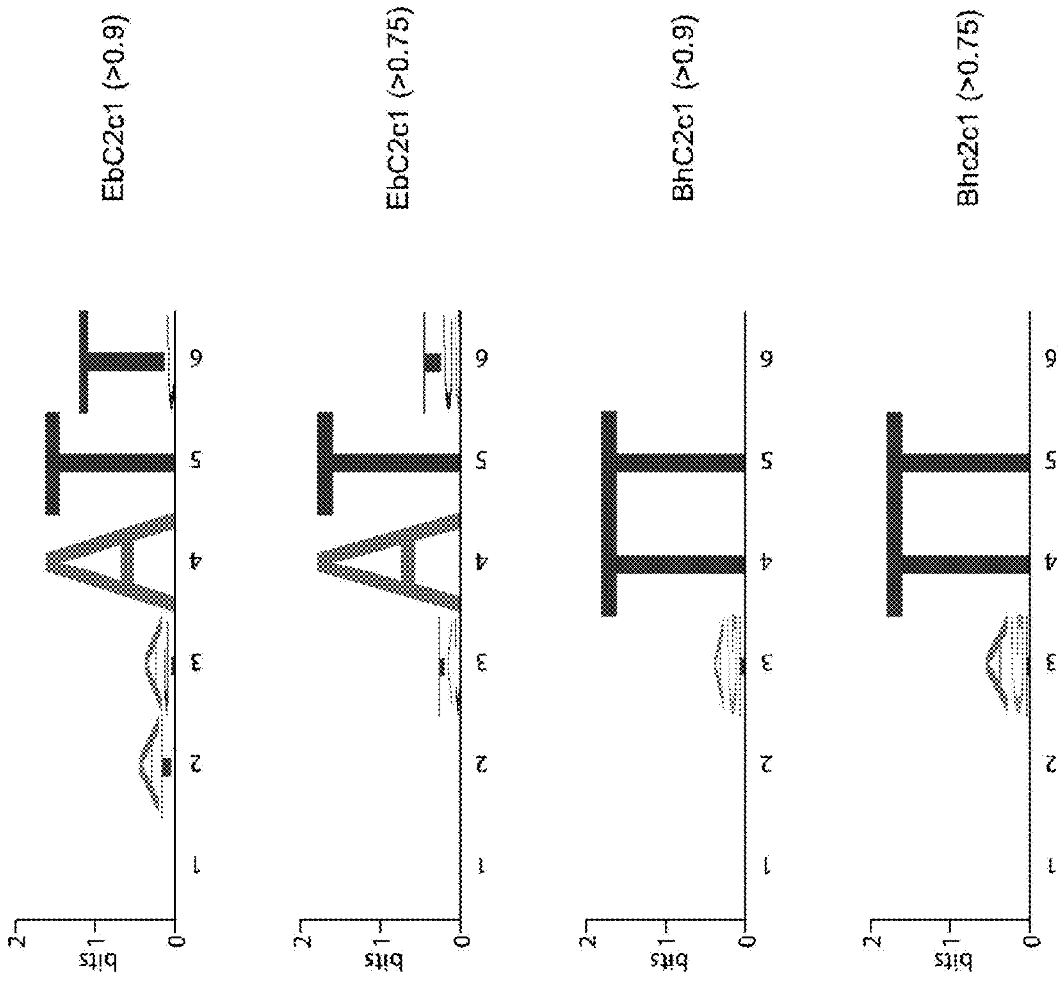
Figure 21A:
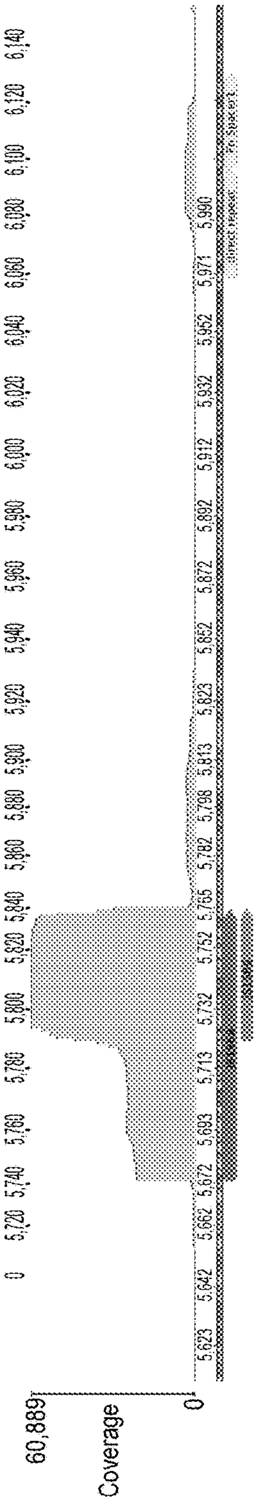
FIG. 21A shows small RNAseq tracr prediction.
Figure 21B:
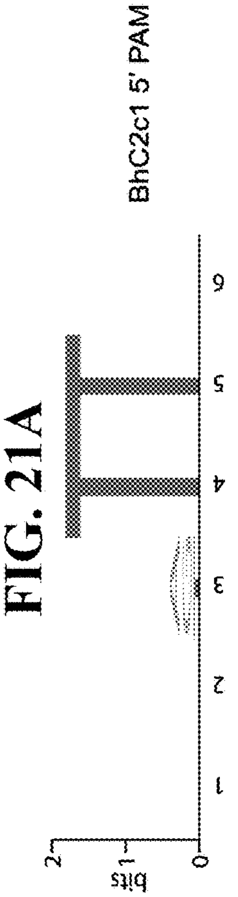
FIG. 21B shows BhC2C1 (*Bacillus hisashii* Cas12b) PAM from in vivo screen.
Figure 21C:
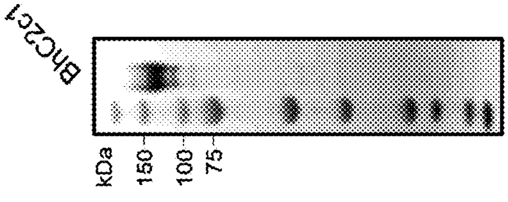
FIG. 21C shows BhC2C1 protein purification.
Figure 21D:
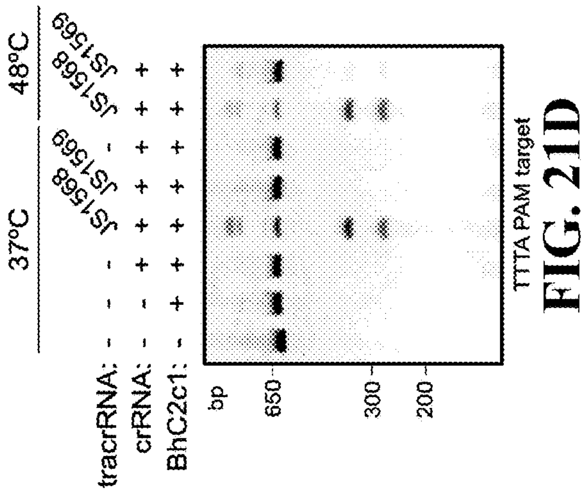
FIG. 21D shows in vitro cleavage with BhC2C1 protein and predicted tracr RNAs at 37° C. and 48° C., respectively.

Mutants of AmC2C1 RuvC were generated and their activities were tested using HEK cell lysates (FIG. 19).

PAMs for Cas12b orthologs was determined by an in vitro PAM screen. In brief, Cas12b proteins and sgRNA were incubated with a PAM library plasmid. The results were shown in FIGS. 20A-20B.

Example 8

*Bacillus hisashii* Cas12b (BhC2C1) was purified and its activity was tested at different temperatures. FIGS. 21A-21D show small RNAseq tracr prediction, BhC2C1 (*Bacillus hisashii* Cas12b) PAM from in vivo screen, BhC2C1 protein purification, in vitro cleavage with BhC2C1 protein and predicted tracr RNAs at 37° C. and 48° C., respectively.

Figure 22A:
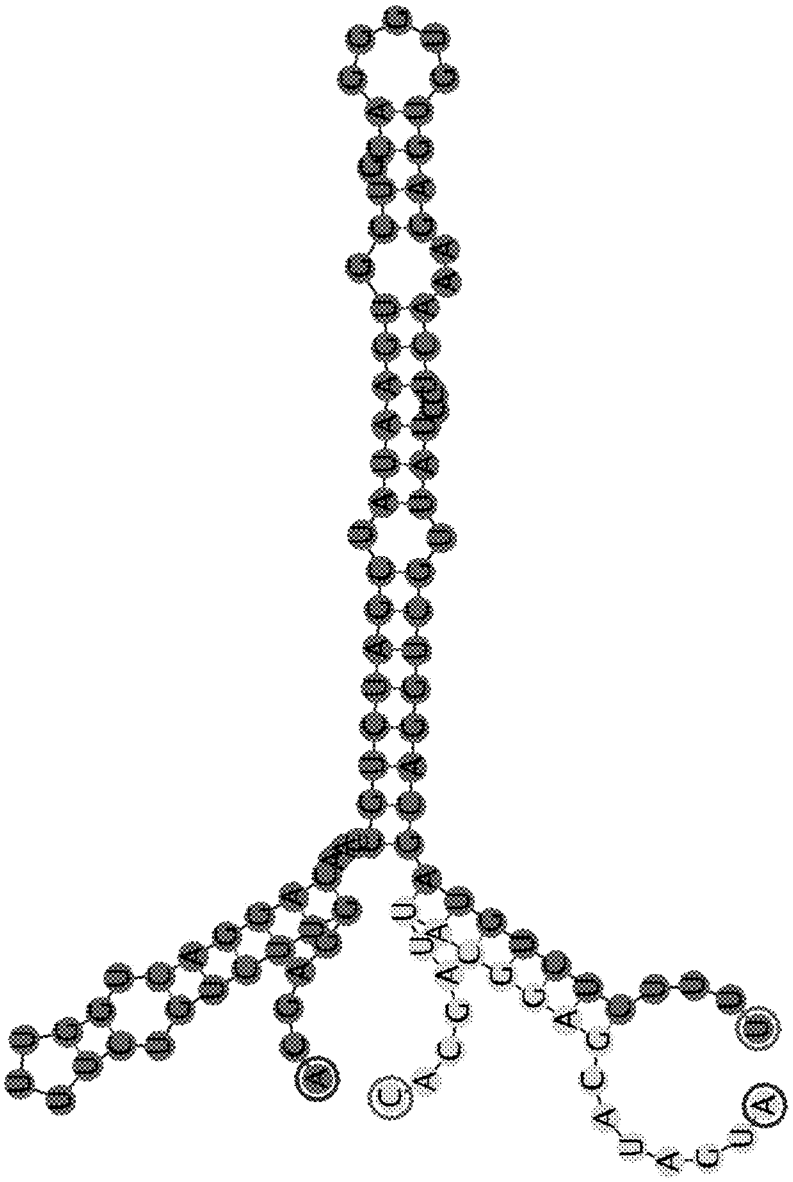
FIGS. 22A-22D show sgRNA designs for BhC2C1.
Figure 22B:
Figure 22C:
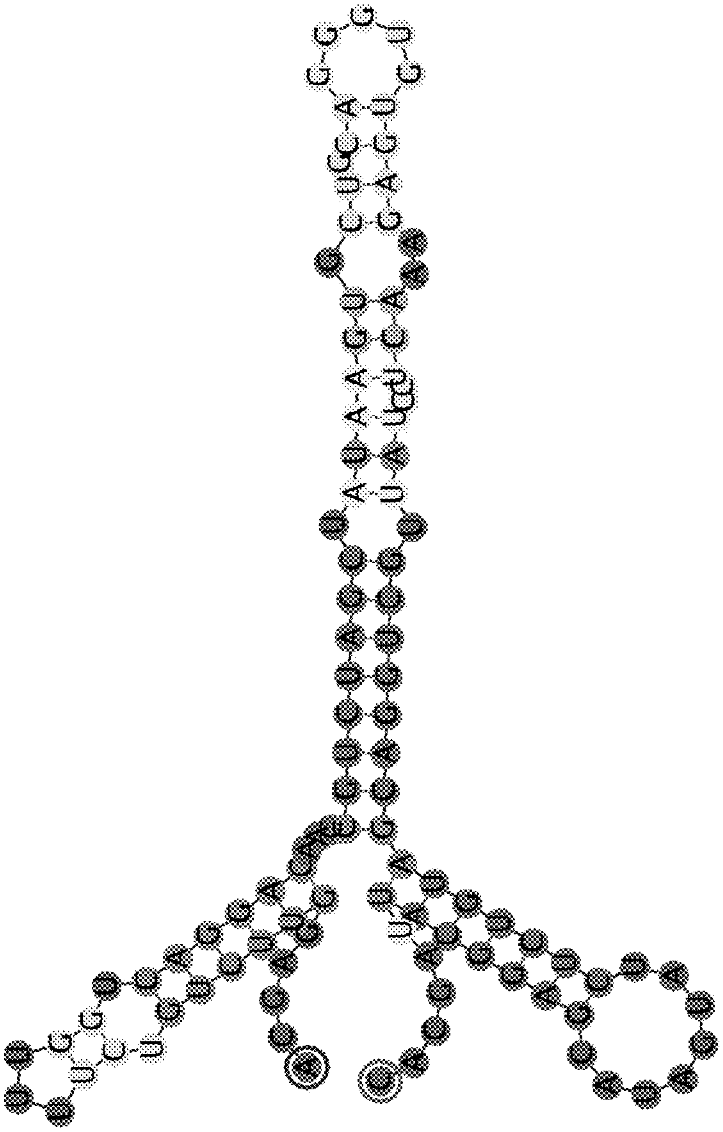
Figure 22D:
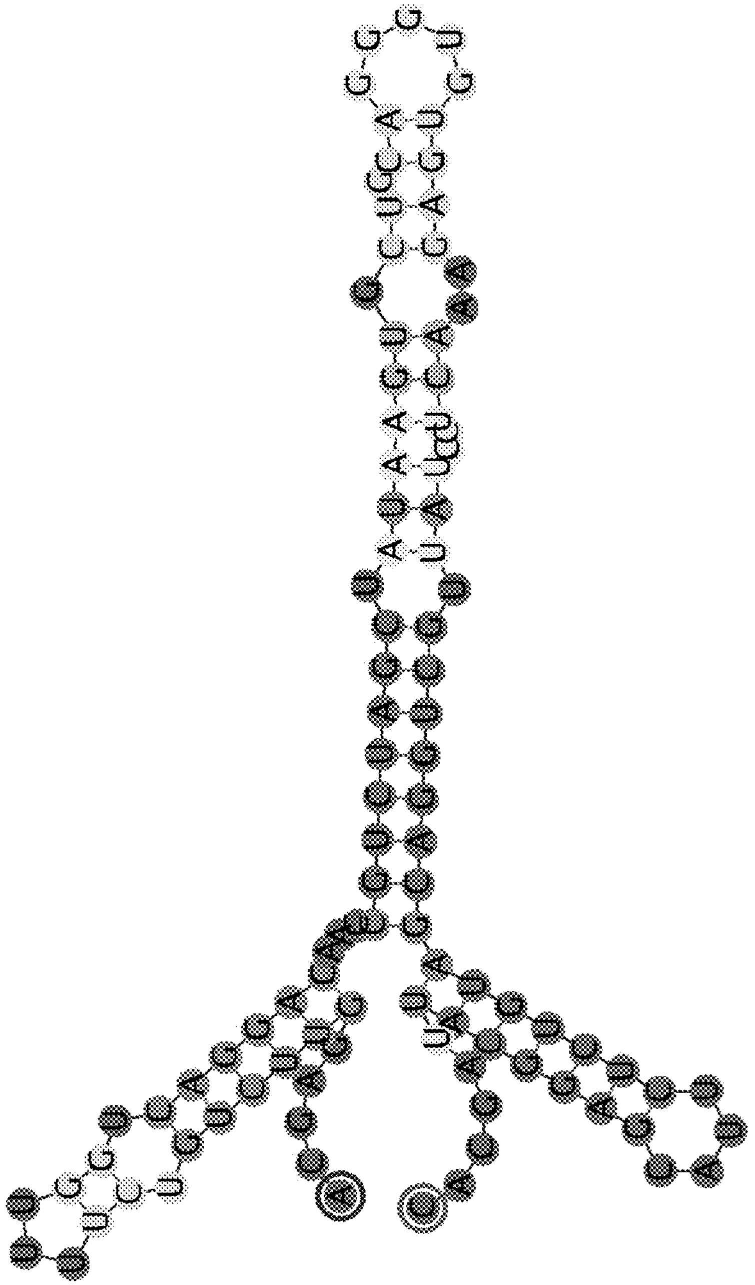

FIGS. 22A-22D show BhC2C1 sgRNA designs. For example, FIG. 22A shows 20nt direct repeat (green) and predicted tracr RNA (red).

Direct repeat sequences, tracr RNA sequences, and sgRNA sequences of BhC2C1 are shown in Table 17 below.

TABLE 17

| BhC2C1 direct repeat sequences | |
|---|---|
| 20 nt | AUGAUACGAGGCAUU AGCAC (SEQ ID NO: 559) |
| full length | GUCCAAGAAAAAAGAAAUG AUACGAGGCAUUAGCAC (SEQ ID NO: 560) |
| **tracr RNA** | |
| JS1568 | ACGAGGUUCUGUCUUUUGGU CAGGACAACCGUCUAGCUAU AAGUGCUGCAGGGUGUGAGA AACUCCUAUUGCUGGACGAU GUCUCUUUU (SEQ ID NO: 561) |
| **sgRNAs** | |
| sgRNA 1 | GAGGUUCUGUCUUUUGGUCA GGACAACCGUCUAGCUAUAA UGGCUGCAGGGUGUGAGAAA CUCCUAUUGCUGGACGAUGU CUCUACGAGGCAUUAGCAC (SEQ ID NO: 562) |
| sgRNA2 | ACGAGGUUCUGUCUUUUGGU CAGGACAACCGUCUAGCUAU AAGUGCUGCAGGGUGUGAGA AACUCCUAUUGCUGGACGAU GUCUCUAUGAUACGAGGCAU UAGCAC (SEQ ID NO: 563) |
| sgRNA3 | ACGAGGUUCUGUCUUUUGGU CAGGACAACCGUCUAGCUAU AAGUGCUGCAGGGUGUGAGA AACUCCUAUUGCUGGACGAU GUCUCUUACGAGGCAUUAGC AC (SEQ ID NO: 564) |

Figure 23:
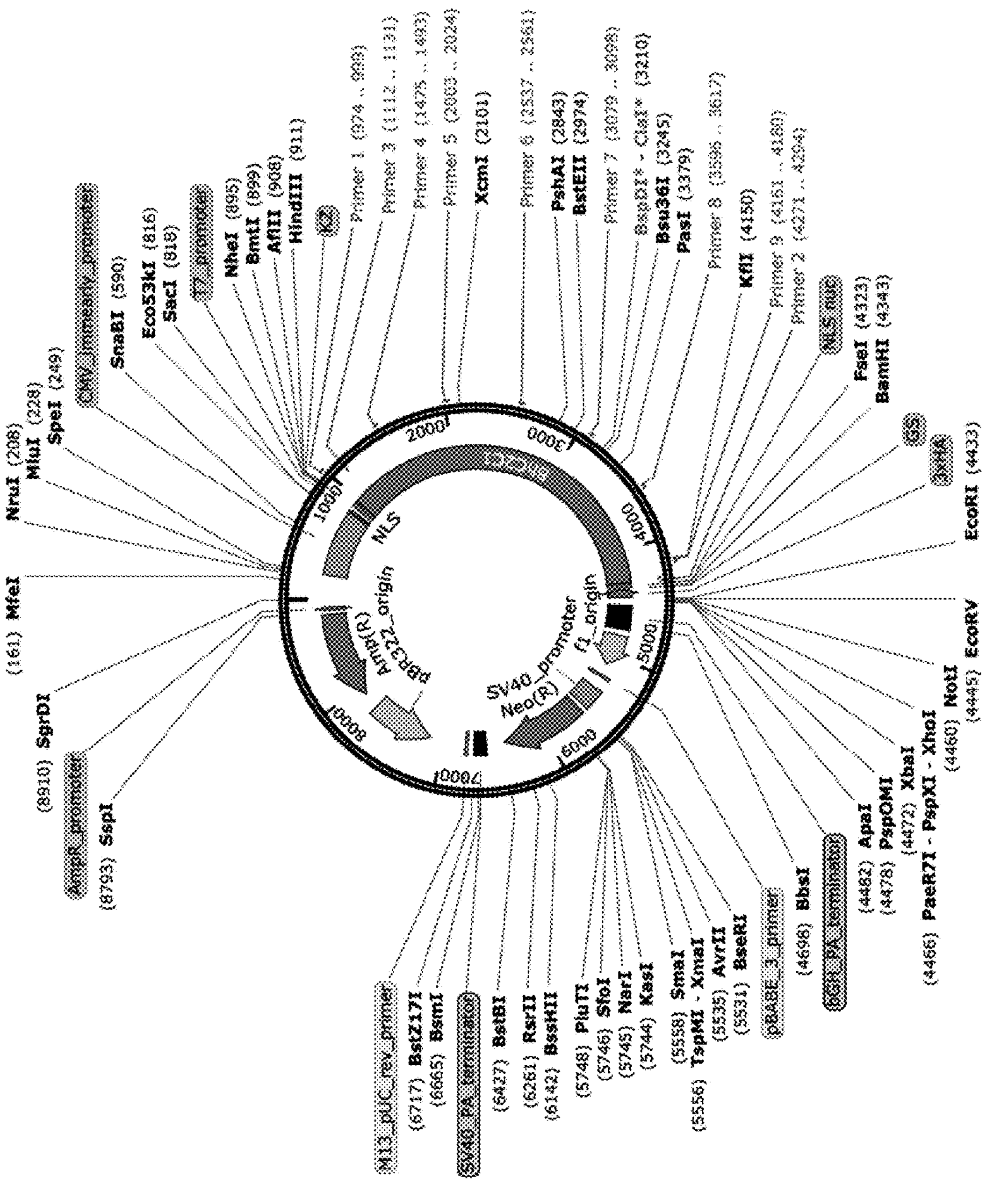
FIG. 23 shows a plasmid map of an exemplary construct containing BhC2C1.

BhC2C1 was cloned into a plasmid. A map of the plasmid is shown in FIG. 23. The scaffold was (SEQ ID NO: 565)
GTTCTGTCTTTTGGTCAGGACAACCGTCTAGCTATAAGTGCTG
CAGGGTGTGAGAAACTCCTATTGCTGGACGACGCCTCTTACGA
GGCGTTAGCACn23_spacer.

Example 9

Figure 24:
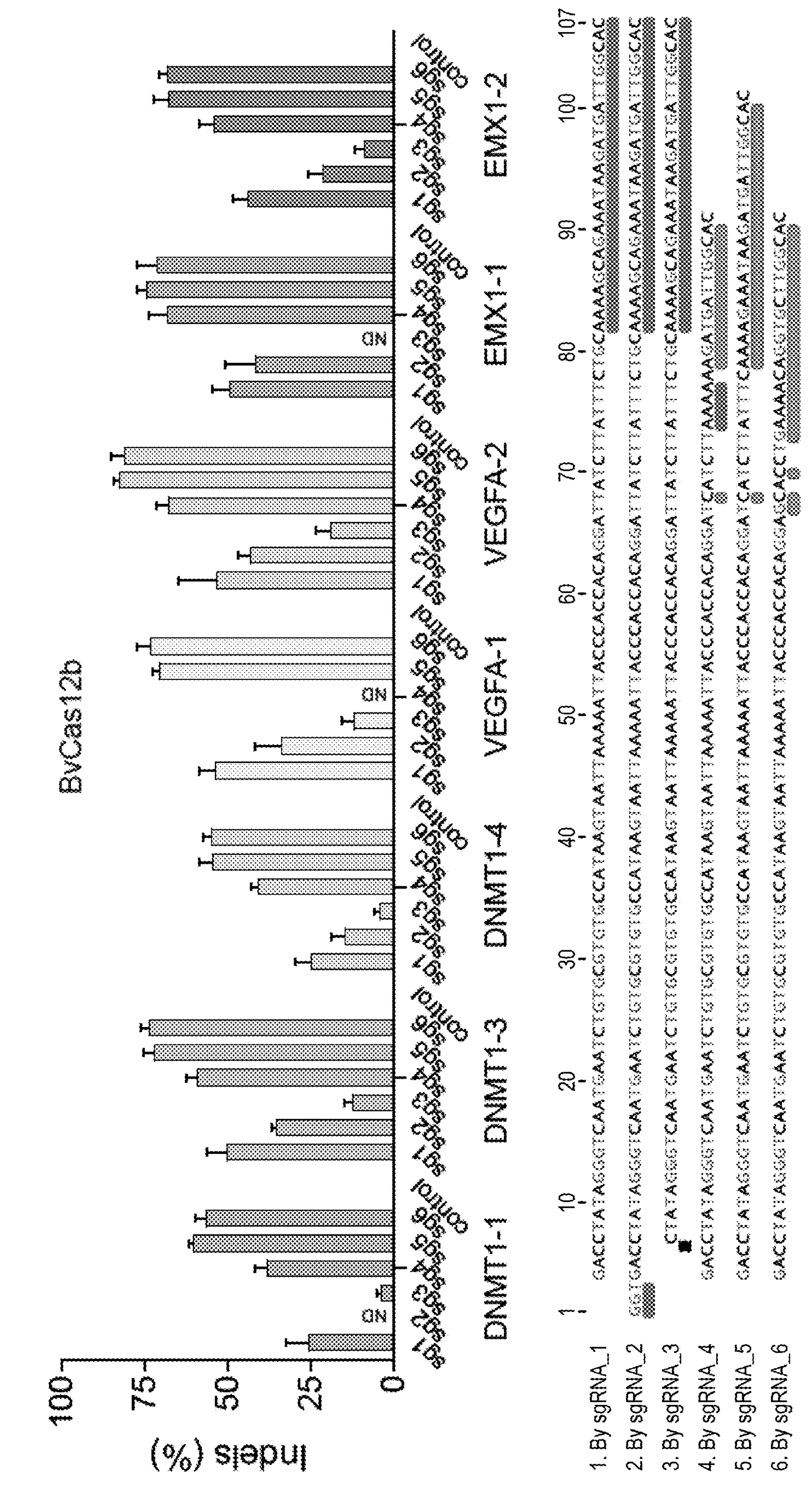
FIG. 24 shows indel percentages obtained with the different sgRNAs in Table 12 after plasmid transfection, for different target sites in Table 12. Cas12b used was BvCas12b. (SEQ ID NO: 42-47)

FIG. 24 shows indel percentage obtained with the different sgRNAs after plasmid transfection, for different target sites. Cas12b used was from *Bacillus* sp. V3-13 (WP_101661451). The protein sequence, sgRNA sequences, and targeted sites are shown in Table 18 below.

TABLE 18

| BvCas12b protien sequence | |
|---|---|
| NLS-BvCas12b-<br>NLS-3xHA<br>(BvCas12b<br>underlined))<br>(SEQ ID<br>NO: 566) | MAPKKKRKVGIHGVPAAAIRSIKLKM<br>KTNSGTDSIYLRKALWRTHQLINEGI<br>AYYMNLLTLYRQEAIGDKTKEAYQAE<br>LINIIRNQQRNNGSSEEHGSDQEILA<br>LLRQLYELIIPSSIGESGDANQLGNK<br>FLYPLVDPNSQSGKGTSNAGRKPRWK<br>RLKEEGNPDWELEKKKDEERKAKDPT<br>VKIFDNLNKYGLLPLFPLFTNIQKDI<br>EWLPLGKRQSVRKWDKDMFIQAIERL<br>LSWESWNRRVADEYKQLKEKTESYYK<br>EHLTGGEEWIEKIRKFEKERNMELEK<br>NAFAPNDGYFITSRQIRGWDRVYEKW<br>SKLPESASPEELWKVVAEQQNKMSEG<br>FGDPKVFSFLANRENRDIWRGHSERI<br>YHIAAYNGLQKKLSRTKEQATFTLPD<br>AIEHPLWIRYESPGGTNLNLFKLEEK<br>QKKNYYVTLSKIIWPSEEKWIEKENI<br>EIPLAPSIQFNRQIKLKQHVKGKQEI<br>SFSDYSSRISLDGVLGGSRIQFNRKY<br>IKNHKELLGEGDIGPVFFNLVVDVAP<br>LQETRNGRLQSPIGKALKVISSDFSK<br>VIDYKPKELMDWMNTGSASNSFGVAS<br>LLEGMRVMSIDMGQRTSASVSIFEVV<br>KELPKDQEQKLFYSINDTELFAIHKR<br>SFLLNLPGEVVTKNNKQQRQERRKKR<br>QFVRSQIRMLANVLRLETKKTPDERK<br>KAIHKLMEIVQSYDSWTASQKEVWEK<br>ELNLLTNMAAFNDEIWKESLVELHHR<br>IEPYVGQIVSKWRKGLSEGRKNLAGI<br>SMWNIDELEDTRRLLISWSKRSRTPG<br>EANRIETDEPFGSSLLQHIQNVKDDR<br>LKQMANLIIMTALGFKYDKEEKDRYK<br>RWKETYPACQIILFENLNRYLFNLDR<br>SRRENSRLMKWAHRSIPRTVSMQGEM<br>FGLQVGDVRSEYSSRFHAKTGAPGIR<br>CHALTEEDLKAGSNTLKRLIEDGFIN<br>ESELAYLKKGDIIPSQGGELFVTLSK<br>RYKKDSDNNELTVIHADINAAQNLQK<br>RFWQQNSEVYRVPCQLARMGEDKLYI<br>PKSQTETIKKYFGKGSFVKNNTEQEV<br>YKWEKSEKMKIKTDTTFDLQDLDGFE<br>DISKTIELAQEQQKKYLTMFRDPSGY<br>FFNNETWRPQKEYWSIVNNIIKSCLK<br>KKILSNKVELKRPAATKKAGQAKKKK<br>GSYPYDVPDYAYPYDVPDYAYPYDVP<br>DYA* |
| **sgRNA sequences** | |
| sgRNA. 1<br>(SEQ ID<br>NO: 567) | GACCUAUAGGGUCAAUGAAUCUGUGCGU<br>GUGCCAUAAGUAAUUAAAAAUUACCCAC<br>CACAGGAUUAUCUUAUUUCUGCAAAAGC<br>AGAAAUAAGAUGAUUGGCAC-<br>nnnnnnnnnnnnnnnnnnnnnnn<br>(23 nt spacer) |

TABLE 18-continued

| | |
|---|---|
| sgRNA.2<br>(SEQ ID<br>NO: 568) | GGUGACCUAUAGGGUCAAUGAAUCUGUG<br>CGUGUGCCAUAAGUAAUUAAAAAUUACC<br>CACCACAGGAUUAUCUUAUUUCUGCAAA<br>AGCAGAAAUAAGAUGAUUGGCAC-<br>nnnnnnnnnnnnnnnnnnnnnnn<br>(23 nt spacer) |
| sgRNA.3<br>(SEQ ID<br>NO: 569) | CUAUAGGGUCAAUGAAUCUGUGCGUGUG<br>CCAUAAGUAAUUAAAAAUUACCCACCAC<br>AGGAUUAUCUUAUUUCUGCAAAAGCAGA<br>AAUAAGAUGAUUGGCAC-<br>nnnnnnnnnnnnnnnnnnnnnnn<br>(23 nt spacer) |
| sgRNA.4<br>(SEQ ID<br>NO: 570) | GACCUAUAGGGUCAAUGAAUCUGUGCGU<br>GUGCCAUAAGUAAUUAAAAAUUACCCAC<br>CACAGGAUCAUCUUAAAAAAGAUGAUUG<br>GCAC-nnnnnnnnnnnnnnnnnnnnnnn<br>(23 nt spacer) |
| sgRNA.5<br>(SEQ ID<br>NO: 571) | GACCUAUAGGGUCAAUGAAUCUGUGCGUG<br>UGCCAUAAGUAAUUAAAAAUUACCCACCA<br>CAGGAUCAUCUUAUUUCAAAAGAAAUAAG<br>AUGAUUGGCAC-nnnnnnnnnnnnnnnn<br>nnnnnnn (23 nt spacer) |
| sgRNA.6<br>(SEQ ID<br>NO: 572) | GACCUAUAGGGUCAAUGAAUCUGUGCGUG<br>UGCCAUAAGUAAUUAAAAAUUACCCACCA<br>CAGGAGCACCUGAAAACAGGUGCUUGGCA<br>C-nnnnnnnnnnnnnnnnnnnnnnn<br>(23 nt spacer) |
| **Target sites** | |
| DNMT1-1:<br>(SEQ ID<br>NO: 573) | CCCTTCAGCTAAAATAAAGGAGG |
| DNMT1-2:<br>(SEQ ID<br>NO: 574) | GGCTCAGCAGGCACCTGCCTCAG |
| DNMT1-3:<br>(SEQ ID<br>NO: 575) | ACGTACTGATGTTAACAGCTGAC |
| VEGFA-1:<br>(SEQ ID<br>NO: 576) | GGGACTGGAGTTGCTTCATGTAC |
| VEGFA-2:<br>(SEQ ID<br>NO: 577) | CTGACCTCCCAAACAGCTACATA |
| EMX1-1:<br>(SEQ ID<br>NO: 578) | TTCATGGAGAAAATATTCAGAAT |
| EMX1-2:<br>(SEQ ID<br>NO: 579) | TCTCCATGAAAAATACTGGGGTC |

Example 10

Figure 25:
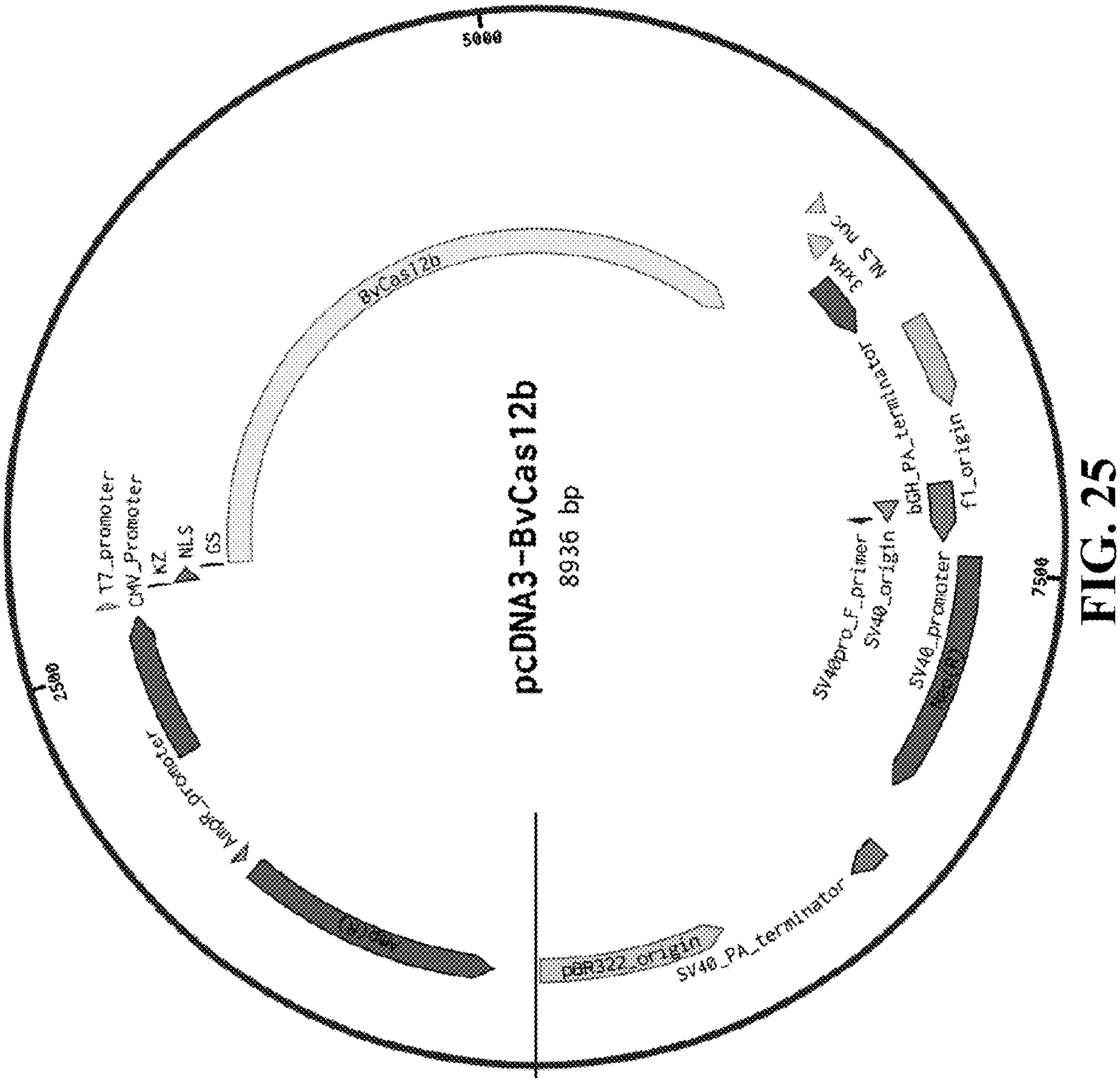
FIG. 25 shows a plasmid map of an exemplary construct containing BvCas12b.

BvCas12b (*Bacillus* sp. V3-13 Cas12b) was cloned into a plasmid (pcDNA3-BvCas12b). A map of the plasmid is shown in FIG. 25. The sequence of the cloned construct is shown in Table 19 below.

TABLE 19

| Sequence of pcDNA3-BvCas12b |
|---|
| AGAACATGTGAGCAAAAGGCCAGCAAAAGGCCAGGAACCGTAAAAAGGCCGC |
| GTTGCTGGCGTTTTTCCATAGGCTCCGCCCCCCTGACGAGCATCACAAAAATCG |

TABLE 19-continued

| Sequence of pcDNA3-BvCas12b |
|---|
| ACGCTCAAGTCAGAGGTGGCGAAACCCGACAGGACTATAAAGATACCAGGCG |
| TTTCCCCCTGGAAGCTCCCTCGTGCGCTCTCCTGTTCCGACCCTGCCGCTTACC |
| GGATACCTGTCCGCCTTTCTCCCTTCGGGAAGCGTGGCGCTTTCTCATAGCTCA |
| CGCTGTAGGTATCTCAGTTCGGTGTAGGTCGTTCGCTCCAAGCTGGGCTGTGTG |
| CACGAACCCCCCGTTCAGCCCGACCGCTGCGCCTTATCCGGTAACTATCGTCTT |
| GAGTCCAACCCGGTAAGACACGACTTATCGCCACTGGCAGCAGCCACTGGTAA |
| CAGGATTAGCAGAGCGAGGTATGTAGGCGGTGCTACAGAGTTCTTGAAGTGGT |
| GGCCTAACTACGGCTACACTAGAAGAACAGTATTTGGTATCTGCGCTCTGCTG |
| AAGCCAGTTACCTTCGGAAAAAGAGTTGGTAGCTCTTGATCCGGCAAACAAAC |
| CACCGCTGGTAGCGGTGGTTTTTTTGTTTGCAAGCAGCAGATTACGCGCAGAA |
| AAAAAGGATCTCAAGAAGATCCTTTGATCTTTTCTACGGGGTCTGACGCTCAGT |
| GGAACGAAAACTCACGTTAAGGGATTTTGGTCATGAGATTATCAAAAAGGATC |
| TTCACCTAGATCCTTTTAAATTAAAAATGAAGTTTTAAATCAATCTAAAGTATA |
| TATGAGTAAACTTGGTCTGACAGTTACCAATGCTTAATCAGTGAGGCACCTATC |
| TCAGCGATCTGTCTATTTCGTTCATCCATAGTTGCCTGACTCCCCGTCGTGTAG |
| ATAACTACGATACGGGAGGGCTTACCATCTGGCCCCAGTGCTGCAATGATACC |
| GCGAGACCCACGCTCACCGGCTCCAGATTTATCAGCAATAAACCAGCCAGCCG |
| GAAGGGCCGAGCGCAGAAGTGGTCCTGCAACTTTATCCGCCTCCATCCAGTCT |
| ATTAATTGTTGCCGGGAAGCTAGAGTAAGTAGTTCGCCAGTTAATAGTTTGCG |
| CAACGTTGTTGCCATTGCTACAGGCATCGTGGTGTCACGCTCGTCGTTTGGTAT |
| GGCTTCATTCAGCTCCGGTTCCCAACGATCAAGGCGAGTTACATGATCCCCCAT |
| GTTGTGCAAAAAAGCGGTTAGCTCCTTCGGTCCTCCGATCGTTGTCAGAAGTA |
| AGTTGGCCGCAGTGTTATCACTCATGGTTATGGCAGCACTGCATAATTCTCTTA |
| CTGTCATGCCATCCGTAAGATGCTTTTCTGTGACTGGTGAGTACTCAACCAAGT |
| CATTCTGAGAATAGTGTATGCGGCGACCGAGTTGCTCTTGCCCGGCGTCAATA |
| CGGGATAATACCGCGCCACATAGCAGAACTTTAAAAGTGCTCATCATTGGAAA |
| ACGTTCTTCGGGGCGAAAACTCTCAAGGATCTTACCGCTGTTGAGATCCAGTTC |
| GATGTAACCCACTCGTGCACCCAACTGATCTTCAGCATCTTTTACTTTCACCAG |
| CGTTTCTGGGTGAGCAAAAACAGGAAGGCAAAATGCCGCAAAAAAGGGAATA |
| AGGGCGACACGGAAATGTTGAATACTCATACTCTTCCTTTTTCAATATTATTGA |
| AGCATTTATCAGGGTTATTGTCTCATGAGCGGATACATATTTGAATGTATTTAG |
| AAAAATAAACAAATAGGGGTTCCGCGCACATTTCCCCGAAAAGTGCCACCTGA |
| CGTCGACGGATCGGGAGATCTCCCGATCCCCTATGGTGCACTCTCAGTACAAT |
| CTGCTCTGATGCCGCATAGTTAAGCCAGTATCTGCTCCCTGCTTGTGTGTTGGA |
| GGTCGCTGAGTAGTGCGCGAGCAAAATTTAAGCTACAACAAGGCAAGGCTTGA |
| CCGACAATTGCATGAAGAATCTGCTTAGGGTTAGGCGTTTTGCGCTGCTTCGCG |
| ATGTACGGGCCAGATATACGCGTTGACATTGATTATTGACTAGTTATTAATAGT |
| AATCAATTACGGGGTCATTAGTTCATAGCCCATATATGGAGTTCCGCGTTACAT |
| AACTTACGGTAAATGGCCCGCCTGGCTGACCGCCCAACGACCCCCGCCCATTG |

TABLE 19-continued

| Sequence of pcDNA3-BvCas12b |
|---|
| ACGTCAATAATGACGTATGTTCCCATAGTAACGCCAATAGGGACTTTCCATTG |
| ACGTCAATGGGTGGAGTATTTACGGTAAACTGCCCACTTGGCAGTACATCAAG |
| TGTATCATATGCCAAGTACGCCCCCTATTGACGTCAATGACGGTAAATGGCCC |
| GCCTGGCATTATGCCCAGTACATGACCTTATGGGACTTTCCTACTTGGCAGTAC |
| ATCTACGTATTAGTCATCGCTATTACCATGGTGATGCGGTTTTGGCAGTACATC |
| AATGGGCGTGGATAGCGGTTTGACTCACGGGGATTTCCAAGTCTCCACCCCAT |
| TGACGTCAATGGGAGTTTGTTTTGGCACCAAAATCAACGGGACTTTCCAAAAT |
| GTCGTAACAACTCCGCCCCATTGACGCAAATGGGCGGTAGGCGTGTACGGTGG |
| GAGGTCTATATAAGCAGAGCTCTCTGGCTAACTAGAGAACCCACTGCTTACTG |
| GCTTATCGAAATTAATACGACTCACTATAGGGAGACCCAAGCTGGCTAGCGTT |
| TAAACTTAAGCTTGCCACCATGGCCCCAAAGAAGAAGCGGAAGGTCGGTATCC |
| ACGGAGTCCCAGCAGCCGGATCCgccgtgaagtccatcaaagtgaagctgcggctgagcgagtgccccga |
| tattctggctggaatgtggcagctgcacagagccacaaatgccggcgtgcggtactacacagaatgggtgtccctgat |
| gcggcaagagatcctgtacagcagaggccctgatggcggccagcagtgttatatgaccgccgaggattgccagagaga |
| gctgctgcggagactgcggaatagacagctgcataacggccggcaggatcagcctggaacagatgctgatctgctggc |
| catcagcagacggctgtacgagattctggtgctgcagagcatcggcaaaagaggcgacgcccagcagattgccagcag |
| ctttctgagccctctggtggaccccaacagcaaaggtggaagaggcgaggccaagagcggaagaaaacctgcctggca |
| gaagatgcgcgaccagggcgatcctagatgggttgccgctagagagaagtacgagcagcggaaggccgtggatcccag |
| caaagagattctgaacagcctggacgccctgggcctcagacctctgtttgccgtgttcaccgagacatacagatccgg |
| cgtggactggaagcctctgggcaaatctcagggcgtcagaacctgggacagagacatgtttcagcaggccctggaacg |
| gctgatgagctgggagagctggaatcggagagtgggcgaagagtacgccagactgttccagcagaaaatgaagttcga |
| gcaagagcacttcgccgagcagagccacctggtcaaactggctagagccctggaagccgatatgagagccgcctctca |
| gggcttcgaggccaaaagaggaacagcccaccagatcaccagaagggcactgagaggggccgacagagtgttcgagat |
| ctggaagtctatccccgaggaagccctgttcagccagtacgacgaagtgatcagacaggtgcaggccgagaagcggag |
| agatttcggcagccatgacctgttcgccaagctggccgagcctaagtatcagcccctttggagagccgacgagacatt |
| cctgaccagatacgccctgtacaacggcgtgctgcgcgatctggaaaaggccagacagttcgccaccttcacactgcc |
| tgatgcctgcgtgaaccccatctggaccagattcgagtctagccagggcagcaacctgcacaaatacgagtttctgtt |
| cgaccacctcggacctggcagacacgccgtcagatttcagagactgctggtggtggaaagcgagggcgccaaagaaag |
| ggatagcgtggtggtgcctgtggctccttctggccaactggataagctggtgctgagggaagaagagaagtccagcgt |
| cgccctgcatctgcacgataccgctagacccgatggcttcatggctgaatgggctggcgccaaactgcagtacgagag |
| aagcaccctggccagaaaagccagacgggacaagcagggcatgagaagctggcggagacagccctccatgctgatgtc |
| tgccgctcagatgctggaagatgccaaacaggctggcgacgtgtacctgaacatcagcgtgcgcgtgaagtctcccag |
| tgaagtgcgaggacagaggcggcctccttacgccgctctgtttagaatcgacgacaagcagcggagagtgaccgtgaa |
| ctacaacaagctgagcgcctacctggaagaacaccccgataagcagatccctggcgctcctggactgctgtctggact |
| gagagtgatgtccgtggacctgggcctgagaacaagcgccagcatctccgtgttcagagtggccaagaaagaagaggt |
| ggaagccctcggagatggccggcctcctcactactatcctatccacggcaccgatgacctggtggccgtgcacgaaag |
| atcccacctgattcagatgcccggcgaaaccgagacaaagcagctgcggaagctgagagaagaacggcaggccgtgct |
| gaggccactgtttgctcaactggcactgctgagactgctcgtcagatgtggcgccgctgacgagagaatcagaaccag |
| atcctggcagcggctgaccaagcagggaagagagttcaccaagagactgacccctagctggcgcgaggctctggaact |

TABLE 19-continued

| Sequence of pcDNA3-BvCas12b |
| --- |
| ggaactgacaagactcgaggcctactgcggcagagtgcccgatgatgagtggtccagaatcgtggacagaaccgtgat |
| tgccctgtggcggagaatgggcaagcaagtgcgcgattggcggaagcaagtgaagtccggggccaaagtgaaagtgaa |
| gggctaccagctggatgtcgtcggcggaaattctctggcccagatcgactatctggaacagcagtacaagttcctgcg |
| gcgttggagcttcttcgccagagcttctggcctggtcgtgcgggccgatagagaaagccattttgccgtggctctgag |
| acagcacatcgagaacgccaagcgggacagactgaagaaactggccgaccggatcctgatggaagcactgggctatgt |
| gtacgaggccagcggacctagagaaggccagtggacagctcagcaccctccttgccagctgatcattctcgaggaact |
| gtccgcctaccggttcagcgacgatagacctcctagcgagaacagcaaactgatggcctggggccacagaggcatcct |
| cgaagaactggtcaaccaggctcaggtgcacgatgtgctcgtgggcacagtgtacgccgccttcagcagcagattcga |
| cgctagaacaggtgctcccggcgtcagatgcagaagagtgcctgccagatttgtgggcgccaccgtggatgattctct |
| gccactgtggctgaccgagttcctggacaagcaccggctggataagaacctgctgcggcccgacgatgtgatcccaac |
| aggcgaaggcgaattcctggtgtccccttgtggcgaagaggctgccagagttagacaggttcacgccgacatcaacgc |
| tgcccagaacctgcagagaaggctgtggcagaacttcgacatcaccgagctgaggctgagatgcgacgtgaagatggg |
| cggagagggaacagtgctggtgcccagagtgaacaacgccagagccaagcagctgttcggcaagaaggtgctggtttc |
| ccaggacggcgtgaccttcttcgagagatctcagacaggcggcaagccccacagcgagaagcagaccgatctgaccga |
| caaagaactcgagctgatcgccgaggccgatgaggccagagctaaaagcgtggtgctgttcagggatcctagcggcca |
| cattggcaaaggccactggatccggcagcgcgagttttggagtctggtcaagcagaggatcgagagccacaccgccga |
| gcggattagagttagaggcgtgggaagctccaggacGGATCCAAAAGGCCGGCGGCCACGAAAAAG |
| GCCGGCCAGGCAAAAAAGAAAAAGggatctTACCCATACGATGTTCCAGATTACG |
| CTTATCCCTACGACGTGCCTGATTATGCATACCCATATGATGTCCCCGACTATG |
| CCtaaGAATTCTGCAGATATCCAGCACAGTGGCGGCCGCTCGAGTCTAGAGGGC |
| CCGTTTAAACCCGCTGATCAGCCTCGACTGTGCCTTCTAGTTGCCAGCCATCTG |
| TTGTTTGCCCCTCCCCCGTGCCTTCCTTGACCCTGGAAGGTGCCACTCCCACTG |
| TCCTTTCCTAATAAAATGAGGAAATTGCATCGCATTGTCTGAGTAGGTGTCATT |
| CTATTCTGGGGGGTGGGGTGGGGCAGGACAGCAAGGGGGAGGATTGGGAAGA |
| CAATAGCAGGCATGCTGGGGATGCGGTGGGCTCTATGGCTTCTGAGGCGGAAA |
| GAACCAGCTGGGGCTCTAGGGGGTATCCCCACGCGCCCTGTAGCGGCGCATTA |
| AGCGCGGCGGGTGTGGTGGTTACGCGCAGCGTGACCGCTACACTTGCCAGCGC |
| CCTAGCGCCCGCTCCTTTCGCTTTCTTCCCTTCCTTTCTCGCCACGTTCGCCGGC |
| TTTCCCCGTCAAGCTCTAAATCGGGGGCTCCCTTTAGGGTTCCGATTTAGTGCT |
| TTACGGCACCTCGACCCCAAAAAACTTGATTAGGGTGATGGTTCACGTAGTGG |
| GCCATCGCCCTGATAGACGGTTTTTCGCCCTTTGACGTTGGAGTCCACGTTCTT |
| TAATAGTGGACTCTTGTTCCAAACTGGAACAACACTCAACCCTATCTCGGTCTA |
| TTCTTTTGATTTATAAGGGATTTTGCCGATTTCGGCCTATTGGTTAAAAAATGA |
| GCTGATTTAACAAAAATTTAACGCGAATTAATTCTGTGGAATGTGTGTCAGTTA |
| GGGTGTGGAAAGTCCCCAGGCTCCCCAGCAGGCAGAAGTATGCAAAGCATGC |
| ATCTCAATTAGTCAGCAACCAGGTGTGGAAAGTCCCCAGGCTCCCCAGCAGGC |
| AGAAGTATGCAAAGCATGCATCTCAATTAGTCAGCAACCATAGTCCCGCCCCT |

TABLE 19-continued

| Sequence of pcDNA3-BvCas12b |
| --- |
| AACTCCGCCCATCCCGCCCCTAACTCCGCCCAGTTCCGCCCATTCTCCGCCCCA<br>TGGCTGACTAATTTTTTTTATTTATGCAGAGGCCGAGGCCGCCTCTGCCTCTGA<br>GCTATTCCAGAAGTAGTGAGGAGGCTTTTTTGGAGGCCTAGGCTTTTGCAAAA<br>AGCTCCCGGGAGCTTGTATATCCATTTTCGGATCTGATCAAGAGACAGGATGA<br>GGATCGTTTCGCATGATTGAACAAGATGGATTGCACGCAGGTTCTCCGGCCGC<br>TTGGGTGGAGAGGCTATTCGGCTATGACTGGGCACAACAGACAATCGGCTGCT<br>CTGATGCCGCCGTGTTCCGGCTGTCAGCGCAGGGGCGCCCGGTTCTTTTTGTCA<br>AGACCGACCTGTCCGGTGCCCTGAATGAACTGCAGGACGAGGCAGCGCGGCTA<br>TCGTGGCTGGCCACGACGGGCGTTCCTTGCGCAGCTGTGCTCGACGTTGTCACT<br>GAAGCGGGAAGGGACTGGCTGCTATTGGGCGAAGTGCCGGGGCAGGATCTCC<br>TGTCATCTCACCTTGCTCCTGCCGAGAAAGTATCCATCATGGCTGATGCAATGC<br>GGCGGCTGCATACGCTTGATCCGGCTACCTGCCCATTCGACCACCAAGCGAAA<br>CATCGCATCGAGCGAGCACGTACTCGGATGGAAGCCGGTCTTGTCGATCAGGA<br>TGATCTGGACGAAGAGCATCAGGGGCTCGCGCCAGCCGAACTGTTCGCCAGGC<br>TCAAGGCGCGCATGCCCGACGGCGAGGATCTCGTCGTGACCCATGGCGATGCC<br>TGCTTGCCGAATATCATGGTGGAAAATGGCCGCTTTTCTGGATTCATCGACTGT<br>GGCCGGCTGGGTGTGGCGGACCGCTATCAGGACATAGCGTTGGCTACCCGTGA<br>TATTGCTGAAGAGCTTGGCGGCGAATGGGCTGACCGCTTCCTCGTGCTTTACGG<br>TATCGCCGCTCCCGATTCGCAGCGCATCGCCTTCTATCGCCTTCTTGACGAGTT<br>CTTCTGAGCGGGACTCTGGGGTTCGAAATGACCGACCAAGCGACGCCCAACCT<br>GCCATCACGAGATTTCGATTCCACCGCCGCCTTCTATGAAAGGTTGGGCTTCGG<br>AATCGTTTTCCGGGACGCCGGCTGGATGATCCTCCAGCGCGGGGATCTCATGC<br>TGGAGTTCTTCGCCCACCCCAACTTGTTTATTGCAGCTTATAATGGTTACAAAT<br>AAAGCAATAGCATCACAAATTTCACAAATAAAGCATTTTTTTCACTGCATTCTA<br>GTTGTGGTTTGTCCAAACTCATCAATGTATCTTATCATGTCTGTATACCGTCGA<br>CCTCTAGCTAGAGCTTGGCGTAATCATGGTCATAGCTGTTTCCTGTGTGAAATT<br>GTTATCCGCTCACAATTCCACACAACATACGAGCCGGAAGCATAAAGTGTAAA<br>GCCTGGGGTGCCTAATGAGTGAGCTAACTCACATTAATTGCGTTGCGCTCACTG<br>CCCGCTTTCCAGTCGGGAAACCTGTCGTGCCAGCTGCATTAATGAATCGGCCA<br>ACGCGCGGGGAGAGGCGGTTTGCGTATTGGGCGCTCTTCCGCTTCCTCGCTCAC<br>TGACTCGCTGCGCTCGGTCGTTCGGCTGCGGCGAGCGGTATCAGCTCACTCAA<br>AGGCGGTAATACGGTTATCCACAGAATCAGGGGATAACGCAGGAA<br>(SEQ ID NO: 580) |

Example 11

Figure 26:
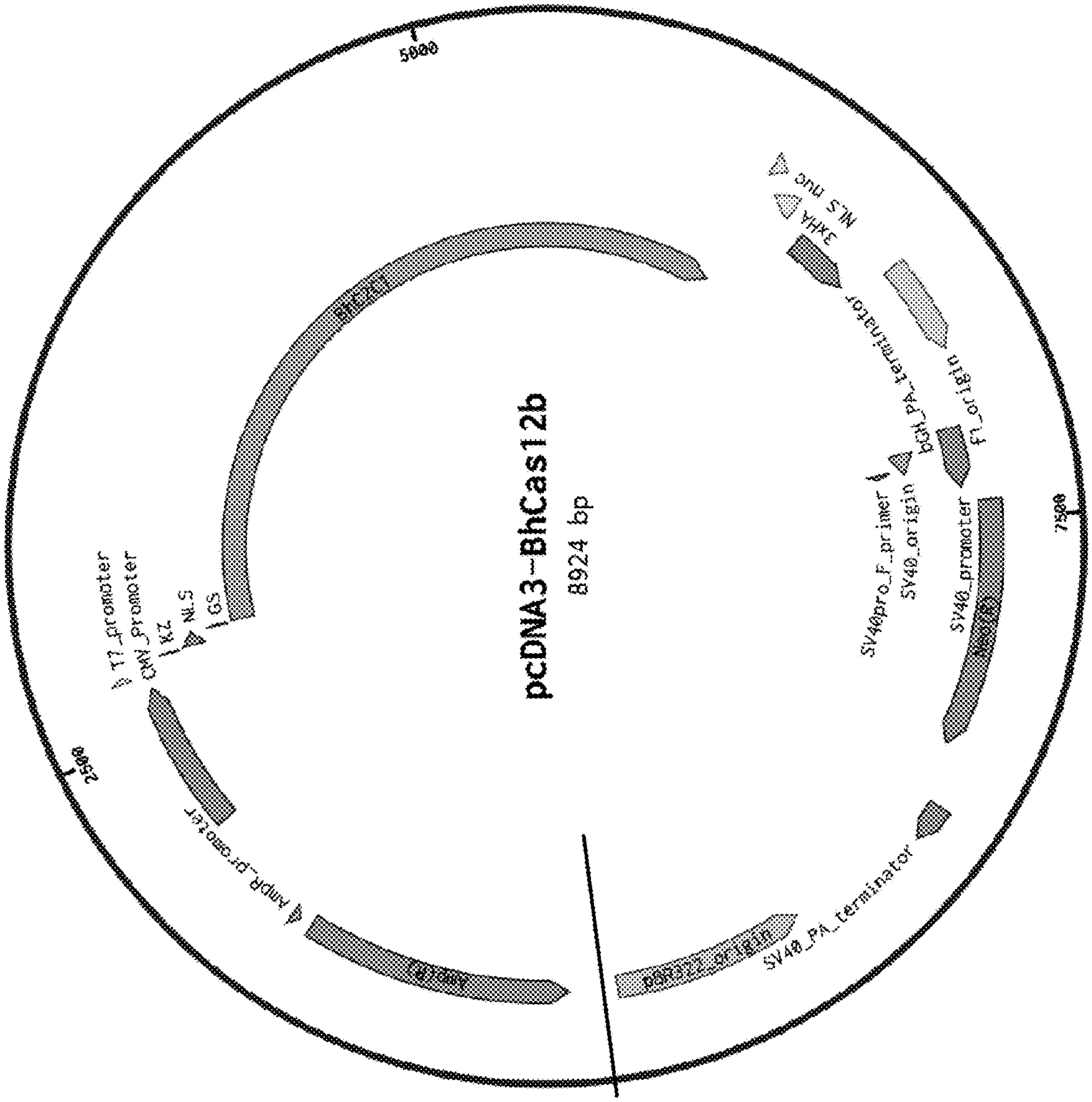
FIG. 26 shows a plasmid map of an exemplary construct containing BhCas12b.

BhCas12b (*Bacillus hisashii* Cas12b) was cloned into a plasmid (pcDNA3-BhCas12b). A map of the plasmid is shown in FIG. 26. The sequence of the cloned construct is shown in Table 20 below.

TABLE 20

| Sequence of pcDNA3-BhCas12b |
|---|
| AGAACATGTGAGCAAAAGGCCAGCAAAAGGCCAGGAACCGTAAAAAGGCC |
| GCGTTGCTGGCGTTTTTCCATAGGCTCCGCCCCCCTGACGAGCATCACAA |
| AAATCGACGCTCAAGTCAGAGGTGGCGAAACCCGACAGGACTATAAAGAT |
| ACCAGGCGTTTCCCCCTGGAAGCTCCCTCGTGCGCTCTCCTGTTCCGACC |
| CTGCCGCTTACCGGATACCTGTCCGCCTTTCTCCCTTCGGGAAGCGTGGC |
| GCTTTCTCATAGCTCACGCTGTAGGTATCTCAGTTCGGTGTAGGTCGTTC |
| GCTCCAAGCTGGGCTGTGTGCACGAACCCCCCGTTCAGCCCGACCGCTGC |
| GCCTTATCCGGTAACTATCGTCTTGAGTCCAACCCGGTAAGACACGACTT |
| ATCGCCACTGGCAGCAGCCACTGGTAACAGGATTAGCAGAGCGAGGTATG |
| TAGGCGGTGCTACAGAGTTCTTGAAGTGGTGGCCTAACTACGGCTACACT |
| AGAAGAACAGTATTTGGTATCTGCGCTCTGCTGAAGCCAGTTACCTTCGG |
| AAAAAGAGTTGGTAGCTCTTGATCCGGCAAACAAACCACCGCTGGTAGCG |
| GTGGTTTTTTTGTTTGCAAGCAGCAGATTACGCGCAGAAAAAAAGGATCT |
| CAAGAAGATCCTTTGATCTTTTCTACGGGGTCTGACGCTCAGTGGAACGA |
| AAACTCACGTTAAGGGATTTTGGTCATGAGATTATCAAAAAGGATCTTCA |
| CCTAGATCCTTTTAAATTAAAAATGAAGTTTTAAATCAATCTAAAGTATA |
| TATGAGTAAACTTGGTCTGACAGTTACCAATGCTTAATCAGTGAGGCACC |
| TATCTCAGCGATCTGTCTATTTCGTTCATCCATAGTTGCCTGACTCCCCG |
| TCGTGTAGATAACTACGATACGGGAGGGCTTACCATCTGGCCCCAGTGCT |
| GCAATGATACCGCGAGACCCACGCTCACCGGCTCCAGATTTATCAGCAAT |
| AAACCAGCCAGCCGGAAGGGCCGAGCGCAGAAGTGGTCCTGCAACTTTAT |
| CCGCCTCCATCCAGTCTATTAATTGTTGCCGGGAAGCTAGAGTAAGTAGT |
| TCGCCAGTTAATAGTTTGCGCAACGTTGTTGCCATTGCTACAGGCATCGT |
| GGTGTCACGCTCGTCGTTTGGTATGGCTTCATTCAGCTCCGGTTCCCAAC |
| GATCAAGGCGAGTTACATGATCCCCCATGTTGTGCAAAAAAGCGGTTAGC |
| TCCTTCGGTCCTCCGATCGTTGTCAGAAGTAAGTTGGCCGCAGTGTTATC |
| ACTCATGGTTATGGCAGCACTGCATAATTCTCTTACTGTCATGCCATCCG |
| TAAGATGCTTTTCTGTGACTGGTGAGTACTCAACCAAGTCATTCTGAGAA |
| TAGTGTATGCGGCGACCGAGTTGCTCTTGCCCGGCGTCAATACGGGATAA |
| TACCGCGCCACATAGCAGAACTTTAAAAGTGCTCATCATTGGAAAACGTT |
| CTTCGGGGCGAAAACTCTCAAGGATCTTACCGCTGTTGAGATCCAGTTCG |
| ATGTAACCCACTCGTGCACCCAACTGATCTTCAGCATCTTTTACTTTCAC |
| CAGCGTTTCTGGGTGAGCAAAAACAGGAAGGCAAAATGCCGCAAAAAAGG |
| GAATAAGGGCGACACGGAAATGTTGAATACTCATACTCTTCCTTTTTCAA |
| TATTATTGAAGCATTTATCAGGGTTATTGTCTCATGAGCGGATACATATT |

TABLE 20-continued

| Sequence of pcDNA3-BhCas12b |
|---|
| TGAATGTATTTAGAAAAATAAACAAATAGGGGTTCCGCGCACATTTCCCC |
| GAAAAGTGCCACCTGACGTCGACGGATCGGGAGATCTCCCGATCCCCTAT |
| GGTGCACTCTCAGTACAATCTGCTCTGATGCCGCATAGTTAAGCCAGTAT |
| CTGCTCCCTGCTTGTGTGTTGGAGGTCGCTGAGTAGTGCGCGAGCAAAAT |
| TTAAGCTACAACAAGGCAAGGCTTGACCGACAATTGCATGAAGAATCTGC |
| TTAGGGTTAGGCGTTTTGCGCTGCTTCGCGATGTACGGGCCAGATATACG |
| CGTTGACATTGATTATTGACTAGTTATTAATAGTAATCAATTACGGGGTC |
| ATTAGTTCATAGCCCATATATGGAGTTCCGCGTTACATAACTTACGGTAA |
| ATGGCCCGCCTGGCTGACCGCCCAACGACCCCCGCCCATTGACGTCAATA |
| ATGACGTATGTTCCCATAGTAACGCCAATAGGGACTTTCCATTGACGTCA |
| ATGGGTGGAGTATTTACGGTAAACTGCCCACTTGGCAGTACATCAAGTGT |
| ATCATATGCCAAGTACGCCCCCTATTGACGTCAATGACGGTAAATGGCCC |
| GCCTGGCATTATGCCCAGTACATGACCTTATGGGACTTTCCTACTTGGCA |
| GTACATCTACGTATTAGTCATCGCTATTACCATGGTGATGCGGTTTTGGC |
| AGTACATCAATGGGCGTGGATAGCGGTTTGACTCACGGGGATTTCCAAGT |
| CTCCACCCCATTGACGTCAATGGGAGTTTGTTTTGGCACCAAAATCAACG |
| GGACTTTCCAAAATGTCGTAACAACTCCGCCCCATTGACGCAAATGGGCG |
| GTAGGCGTGTACGGTGGGAGGTCTATATAAGCAGAGCTCTCTGGCTAACT |
| AGAGAACCCACTGCTTACTGGCTTATCGAAATTAATACGACTCACTATAG |
| GGAGACCCAAGCTGGCTAGCGTTTAAACTTAAGCTTGCCACCATGGCCCC |
| AAAGAAGAAGCGGAAGGTCGGTATCCACGGAGTCCCAGCAGCCGGATCCG |
| CCACCAGATCCTTCATCCTGAAGATCGAGCCCAACGAGGAAGTGAAGAAA |
| GGCCTCTGGAAAACCCACGAGGTGCTGAACCACGGAATCGCCTACTACAT |
| GAATATCCTGAAGCTGATCCGGCAAGAGGCCATCTACGAGCACCACGAGC |
| AGGACCCCAAGAATCCCAAGAAGGTGTCCAAGGCCGAGATCCAGGCCGAG |
| CTGTGGGATTTCGTGCTGAAGATGCAGAAGTGCAACAGCTTCACACACGA |
| GGTGGACAAGGACGAGGTGTTCAACATCCTGAGAGAGCTGTACGAGGAAC |
| TGGTGCCCAGCAGCGTGGAAAAGAAGGGCGAAGCCAACCAGCTGAGCAAC |
| AAGTTTCTGTACCCTCTGGTGGACCCCAACAGCCAGTCTGGAAAGGGAAC |
| AGCCAGCAGCGGCAGAAAGCCCAGATGGTACAACCTGAAGATTGCCGGCG |
| ATCCCTCCTGGGAAGAAGAGAAGAAGAAGTGGGAAGAAGATAAGAAAAAG |
| GACCCGCTGGCCAAGATCCTGGGCAAGCTGGCTGAGTACGGACTGATCCC |
| TCTGTTCATCCCCTACACCGACAGCAACGAGCCCATCGTGAAAGAAATCA |
| AGTGGATGGAAAAGTCCCGGAACCAGAGCGTGCGGCGGCTGGATAAGGAC |
| ATGTTCATTCAGGCCCTGGAACGGTTCCTGAGCTGGGAGAGCTGGAACCT |
| GAAAGTGAAAGAGGAATACGAGAAGGTCGAGAAAGAGTACAAGACCCTGG |
| AAGAGAGGATCAAAGAGGACATCCAGGCTCTGAAGGCTCTGGAACAGTAT |
| GAGAAAGAGCGGCAAGAACAGCTGCTGCGGGACACCCTGAACACCAACGA |
| GTACCGGCTGAGCAAGAGAGGCCTTAGAGGCTGGCGGGAAATCATCCAGA |

TABLE 20-continued

| Sequence of pcDNA3-BhCas12b |
| --- |
| AATGGCTGAAAATGGACGAGAACGAGCCCTCCGAGAAGTACCTGGAAGTG |
| TTCAAGGACTACCAGCGGAAGCACCCTAGAGAGGCCGGCGATTACAGCGT |
| GTACGAGTTCCTGTCCAAGAAAGAGAACCACTTCATCTGGCGGAATCACC |
| CTGAGTACCCCTACCTGTACGCCACCTTCTGCGAGATCGACAAGAAAAAG |
| AAGGACGCCAAGCAGCAGGCCACCTTCACACTGGCCGATCCTATCAATCA |
| CCCTCTGTGGGTCCGATTCGAGGAAAGAAGCGGCAGCAACCTGAACAAGT |
| ACAGAATCCTGACCGAGCAGCTGCACACCGAGAAGCTGAAGAAAAAGCTG |
| ACAGTGCAGCTGGACCGGCTGATCTACCCTACAGAATCTGGCGGCTGGGA |
| AGAGAAGGGCAAAGTGGACATTGTGCTGCTGCCCAGCCGGCAGTTCTACA |
| ACCAGATCTTCCTGGACATCGAGGAAAAGGGCAAGCACGCCTTCACCTAC |
| AAGGATGAGAGCATCAAGTTCCCTCTGAAGGGCACACTCGGCGGAGCCAG |
| AGTGCAGTTCGACAGAGATCACCTGAGAAGATACCCTCACAAGGTGGAAA |
| GCGGCAACGTGGGCAGAATCTACTTCAACATGACCGTGAACATCGAGCCT |
| ACAGAGTCCCCAGTGTCCAAGTCTCTGAAGATCCACCGGGACGACTTCCC |
| CAAGGTGGTCAACTTCAAGCCCAAAGAACTGACCGAGTGGATCAAGGACA |
| GCAAGGGCAAGAAACTGAAGTCCGGCATCGAGTCCCTGGAAATCGGCCTG |
| AGAGTGATGAGCATCGACCTGGGACAGAGACAGGCCGCTGCCGCCTCTAT |
| TTTCGAGGTGGTGGATCAGAAGCCCGACATCGAAGGCAAGCTGTTTTTCC |
| CAATCAAGGGCACCGAGCTGTATGCCGTGCACAGAGCCAGCTTCAACATC |
| AAGCTGCCCGGCGAGACACTGGTCAAGAGCAGAGAAGTGCTGCGGAAGGC |
| CAGAGAGGACAATCTGAAACTGATGAACCAGAAGCTCAACTTCCTGCGGA |
| ACGTGCTGCACTTCCAGCAGTTCGAGGACATCACCGAGAGAGAGAAGCGG |
| GTCACCAAGTGGATCAGCAGACAAGAGAACAGCGACGTGCCCCTGGTGTA |
| CCAGGATGAGCTGATCCAGATCCGCGAGCTGATGTACAAGCCTTACAAGG |
| ACTGGGTCGCCTTCCTGAAGCAGCTCCACAAGAGACTGGAAGTCGAGATC |
| GGCAAAGAAGTGAAGCACTGGCGGAAGTCCCTGAGCGACGGAAGAAAGGG |
| CCTGTACGGCATCTCCCTGAAGAACATCGACGAGATCGATCGGACCCGGA |
| AGTTCCTGCTGAGATGGTCCCTGAGGCCTACCGAACCTGGCGAAGTGCGT |
| AGACTGGAACCCGGCCAGAGATTCGCCATCGACCAGCTGAATCACCTGAA |
| CGCCCTGAAAGAAGATCGGCTGAAGAAGATGGCCAACACCATCATCATGC |
| ACGCCCTGGGCTACTGCTACGACGTGCGGAAGAAGAAATGGCAGGCTAAG |
| AACCCCGCCTGCCAGATCATCCTGTTCGAGGATCTGAGCAACTACAACCC |
| CTACGAGGAAAGGTCCCGCTTCGAGAACAGCAAGCTCATGAAGTGGTCCA |
| GACGCGAGATCCCCAGACAGGTTGCACTGCAGGGCGAGATCTATGGCCTG |
| CAAGTGGGAGAAGTGGGCGCTCAGTTCAGCAGCAGATTCCACGCCAAGAC |
| AGGCAGCCCTGGCATCAGATGTAGCGTCGTGACCAAAGAGAAGCTGCAGG |
| ACAATCGGTTCTTCAAGAATCTGCAGAGAGAGGGCAGACTGACCCTGGAC |
| AAAATCGCCGTGCTGAAAGAGGGCGATCTGTACCCAGACAAAGGCGGCGA |
| GAAGTTCATCAGCCTGAGCAAGGATCGGAAGTGCGTGACCACACACGCCG |
| ACATCAACGCCGCTCAGAACCTGCAGAAGCGGTTCTGGACAAGAACCCAC |
| GGCTTCTACAAGGTGTACTGCAAGGCCTACCAGGTGGACGGCCAGACCGT |
| GTACATCCCTGAGAGCAAGGACCAGAAGCAGAAGATCATCGAAGAGTTCG |
| GCGAGGGCTACTTCATTCTGAAGGACGGGGTGTACGAATGGGTCAACGCC |
| GGCAAGCTGAAAATCAAGAAGGGCAGCTCCAAGCAGAGCAGCAGCGAGCT |
| GGTGGATAGCGACATCCTGAAAGACAGCTTCGACCTGGCCTCCGAGCTGA |
| AAGGCGAAAAGCTGATGCTGTACAGGGACCCCAGCGGCAATGTGTTCCCC |
| AGCGACAAATGGATGGCCGCTGGCGTGTTCTTCGGAAAGCTGGAACGCAT |
| CCTGATCAGCAAGCTGACCAACCAGTACTCCATCAGCACCATCGAGGACG |
| ACAGCAGCAAGCAGTCTATGGGATCCAAAAGGCCGGCGGCCACGAAAAAG |
| GCCGGCCAGGCAAAAAAGAAAAAGggatctTACCCATACGATGTTCCAGA |
| TTACGCTTATCCCTACGACGTGCCTGATTATGCATACCCATATGATGTCC |
| CCGACTATGCCtaaGAATTCTGCAGATATCCAGCACAGTGGCGGCCGCTC |
| GAGTCTAGAGGGCCCGTTTAAACCCGCTGATCAGCCTCGACTGTGCCTTC |
| TAGTTGCCAGCCATCTGTTGTTTGCCCCTCCCCCGTGCCTTCCTTGACCC |
| TGGAAGGTGCCACTCCCACTGTCCTTTCCTAATAAAATGAGGAAATTGCA |
| TCGCATTGTCTGAGTAGGTGTCATTCTATTCTGGGGGGTGGGGTGGGGCA |
| GGACAGCAAGGGGGAGGATTGGGAAGACAATAGCAGGCATGCTGGGGATG |
| CGGTGGGCTCTATGGCTTCTGAGGCGGAAAGAACCAGCTGGGGCTCTAGG |
| GGGTATCCCCACGCGCCCTGTAGCGGCGCATTAAGCGCGGCGGGTGTGGT |
| GGTTACGCGCAGCGTGACCGCTACACTTGCCAGCGCCCTAGCGCCCGCTC |
| CTTTCGCTTTCTTCCCTTCCTTTCTCGCCACGTTCGCCGGCTTTCCCCGT |
| CAAGCTCTAAATCGGGGGCTCCCTTTAGGGTTCCGATTTAGTGCTTTACG |
| GCACCTCGACCCCAAAAAACTTGATTAGGGTGATGGTTCACGTAGTGGGC |
| CATCGCCCTGATAGACGGTTTTTCGCCCTTTGACGTTGGAGTCCACGTTC |
| TTTAATAGTGGACTCTTGTTCCAAACTGGAACAACACTCAACCCTATCTC |
| GGTCTATTCTTTTGATTTATAAGGGATTTTGCCGATTTCGGCCTATTGGT |
| TAAAAAATGAGCTGATTTAACAAAAATTTAACGCGAATTAATTCTGTGGA |
| ATGTGTGTCAGTTAGGGTGTGGAAAGTCCCCAGGCTCCCCAGCAGGCAGA |
| AGTATGCAAAGCATGCATCTCAATTAGTCAGCAACCAGGTGTGGAAAGTC |
| CCCAGGCTCCCCAGCAGGCAGAAGTATGCAAAGCATGCATCTCAATTAGT |
| CAGCAACCATAGTCCCGCCCCTAACTCCGCCCATCCCGCCCCTAACTCCG |
| CCCAGTTCCGCCCATTCTCCGCCCCATGGCTGACTAATTTTTTTTATTTA |
| TGCAGAGGCCGAGGCCGCCTCTGCCTCTGAGCTATTCCAGAAGTAGTGAG |
| GAGGCTTTTTTGGAGGCCTAGGCTTTTGCAAAAAGCTCCCGGGAGCTTGT |
| ATATCCATTTTCGGATCTGATCAAGAGACAGGATGAGGATCGTTTCGCAT |
| GATTGAACAAGATGGATTGCACGCAGGTTCTCCGGCCGCTTGGGTGGAGA |
| GGCTATTCGGCTATGACTGGGCACAACAGACAATCGGCTGCTCTGATGCC |
| GCCGTGTTCCGGCTGTCAGCGCAGGGGCGCCCGGTTCTTTTTGTCAAGAC |

TABLE 20-continued

| Sequence of pcDNA3-BhCas12b |
|---|
| CGACCTGTCCGGTGCCCTGAATGAACTGCAGGACGAGGCAGCGCGGCTAT |
| CGTGGCTGGCCACGACGGGCGTTCCTTGCGCAGCTGTGCTCGACGTTGTC |
| ACTGAAGCGGGAAGGGACTGGCTGCTATTGGGCGAAGTGCCGGGGCAGGA |
| TCTCCTGTCATCTCACCTTGCTCCTGCCGAGAAAGTATCCATCATGGCTG |
| ATGCAATGCGGCGGCTGCATACGCTTGATCCGGCTACCTGCCCATTCGAC |
| CACCAAGCGAAACATCGCATCGAGCGAGCACGTACTCGGATGGAAGCCGG |
| TCTTGTCGATCAGGATGATCTGGACGAAGAGCATCAGGGGCTCGCGCCAG |
| CCGAACTGTTCGCCAGGCTCAAGGCGCGCATGCCCGACGGCGAGGATCTC |
| GTCGTGACCCATGGCGATGCCTGCTTGCCGAATATCATGGTGGAAAATGG |
| CCGCTTTTCTGGATTCATCGACTGTGGCCGGCTGGGTGTGGCGGACCGCT |
| ATCAGGACATAGCGTTGGCTACCCGTGATATTGCTGAAGAGCTTGGCGGC |
| GAATGGGCTGACCGCTTCCTCGTGCTTTACGGTATCGCCGCTCCCGATTC |
| GCAGCGCATCGCCTTCTATCGCCTTCTTGACGAGTTCTTCTGAGCGGGAC |
| TCTGGGGTTCGAAATGACCGACCAAGCGACGCCCAACCTGCCATCACGAG |
| ATTTCGATTCCACCGCCGCCTTCTATGAAAGGTTGGGCTTCGGAATCGTT |
| TTCCGGGACGCCGGCTGGATGATCCTCCAGCGCGGGGATCTCATGCTGGA |
| GTTCTTCGCCCACCCCAACTTGTTTATTGCAGCTTATAATGGTTACAAAT |
| AAAGCAATAGCATCACAAATTTCACAAATAAAGCATTTTTTTCACTGCAT |
| TCTAGTTGTGGTTTGTCCAAACTCATCAATGTATCTTATCATGTCTGTAT |
| ACCGTCGACCTCTAGCTAGAGCTTGGCGTAATCATGGTCATAGCTGTTTC |
| CTGTGTGAAATTGTTATCCGCTCACAATTCCACACAACATACGAGCCGGA |
| AGCATAAAGTGTAAAGCCTGGGGTGCCTAATGAGTGAGCTAACTCACATT |
| AATTGCGTTGCGCTCACTGCCCGCTTTCCAGTCGGGAAACCTGTCGTGCC |
| AGCTGCATTAATGAATCGGCCAACGCGCGGGGAGAGGCGGTTTGCGTATT |
| GGGCGCTCTTCCGCTTCCTCGCTCACTGACTCGCTGCGCTCGGTCGTTCG |
| GCTGCGGCGAGCGGTATCAGCTCACTCAAAGGCGGTAATACGGTTATCCA |
| CAGAATCAGGGGATAACGCAGGAA (SEQ ID NO: 581) |

Example 12

Figure 27:
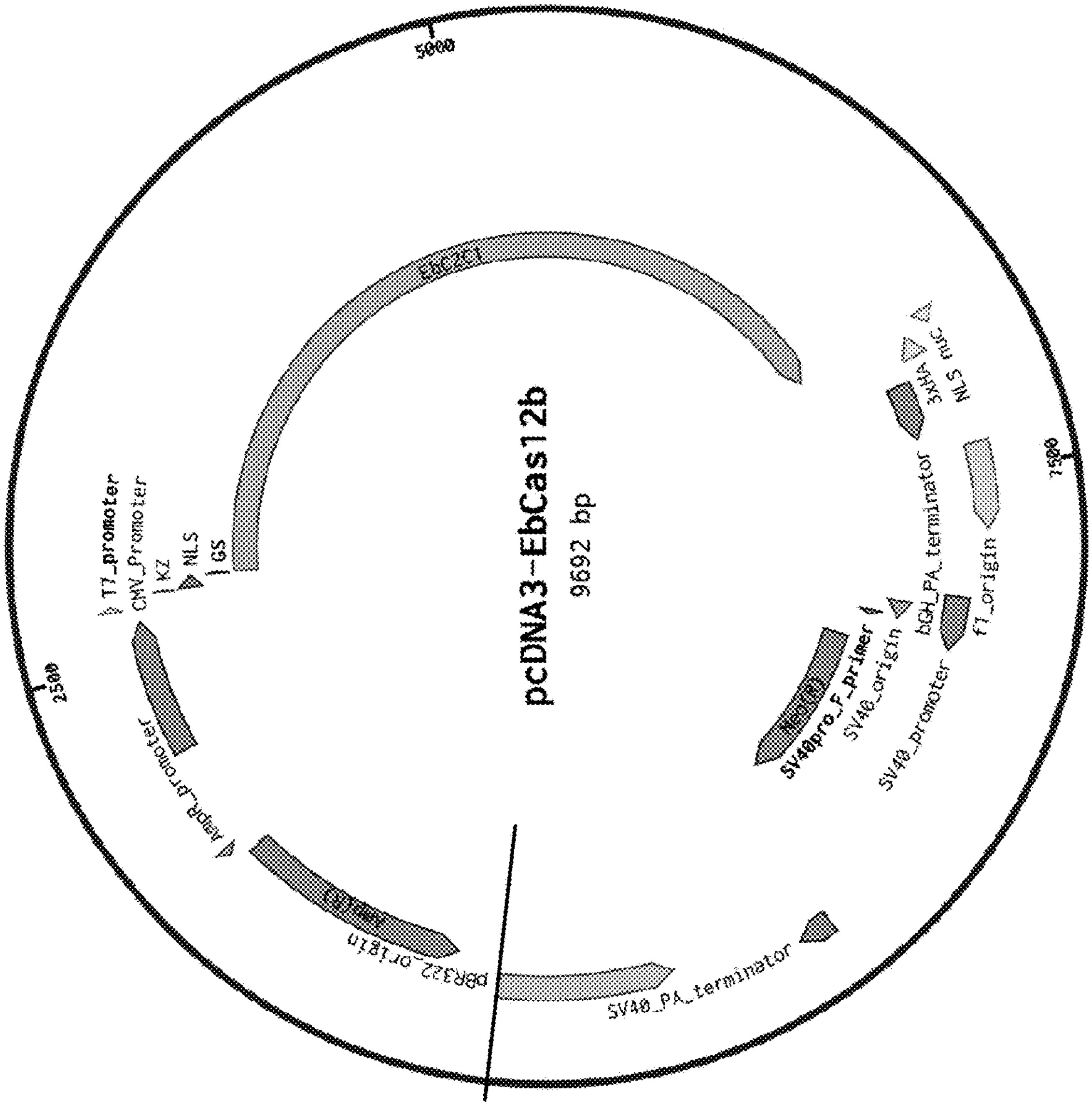
FIG. 27 shows a plasmid map of an exemplary construct containing EbCas12b.

EbCas12b (Elusimicrobia bacterium Cas12b) was cloned into a plasmid (pcDNA3-EbCas12b). A map of the plasmid is shown in FIG. 27. The sequence of the cloned construct is shown in Table 21 below.

TABLE 21

| Sequence of pcDNA3-EbCas12b |
|---|
| AGAACATGTGAGCAAAAGGCCAGCAAAAGGCCAGGAACCGTAAAAAGGCC |
| GCGTTGCTGGCGTTTTTCCATAGGCTCCGCCCCCCTGACGAGCATCACAA |
| AAATCGACGCTCAAGTCAGAGGTGGCGAAACCCGACAGGACTATAAAGAT |
| ACCAGGCGTTTCCCCCTGGAAGCTCCCTCGTGCGCTCTCCTGTTCCGACC |
| CTGCCGCTTACCGGATACCTGTCCGCCTTTCTCCCTTCGGGAAGCGTGGC |
| GCTTTCTCATAGCTCACGCTGTAGGTATCTCAGTTCGGTGTAGGTCGTTC |
| GCTCCAAGCTGGGCTGTGTGCACGAACCCCCCGTTCAGCCCGACCGCTGC |
| GCCTTATCCGGTAACTATCGTCTTGAGTCCAACCCGGTAAGACACGACTT |
| ATCGCCACTGGCAGCAGCCACTGGTAACAGGATTAGCAGAGCGAGGTATG |
| TAGGCGGTGCTACAGAGTTCTTGAAGTGGTGGCCTAACTACGGCTACACT |
| AGAAGAACAGTATTTGGTATCTGCGCTCTGCTGAAGCCAGTTACCTTCGG |
| AAAAAGAGTTGGTAGCTCTTGATCCGGCAAACAAACCACCGCTGGTAGCG |
| GTGGTTTTTTTGTTTGCAAGCAGCAGATTACGCGCAGAAAAAAAGGATCT |
| CAAGAAGATCCTTTGATCTTTTCTACGGGGTCTGACGCTCAGTGGAACGA |
| AAACTCACGTTAAGGGATTTTGGTCATGAGATTATCAAAAAGGATCTTCA |
| CCTAGATCCTTTTAAATTAAAAATGAAGTTTTAAATCAATCTAAAGTATA |
| TATGAGTAAACTTGGTCTGACAGTTACCAATGCTTAATCAGTGAGGCACC |
| TATCTCAGCGATCTGTCTATTTCGTTCATCCATAGTTGCCTGACTCCCCG |
| TCGTGTAGATAACTACGATACGGGAGGGCTTACCATCTGGCCCCAGTGCT |
| GCAATGATACCGCGAGACCCACGCTCACCGGCTCCAGATTTATCAGCAAT |
| AAACCAGCCAGCCGGAAGGGCCGAGCGCAGAAGTGGTCCTGCAACTTTAT |
| CCGCCTCCATCCAGTCTATTAATTGTTGCCGGGAAGCTAGAGTAAGTAGT |
| TCGCCAGTTAATAGTTTGCGCAACGTTGTTGCCATTGCTACAGGCATCGT |
| GGTGTCACGCTCGTCGTTTGGTATGGCTTCATTCAGCTCCGGTTCCCAAC |
| GATCAAGGCGAGTTACATGATCCCCCATGTTGTGCAAAAAAGCGGTTAGC |
| TCCTTCGGTCCTCCGATCGTTGTCAGAAGTAAGTTGGCCGCAGTGTTATC |
| ACTCATGGTTATGGCAGCACTGCATAATTCTCTTACTGTCATGCCATCCG |
| TAAGATGCTTTTCTGTGACTGGTGAGTACTCAACCAAGTCATTCTGAGAA |
| TAGTGTATGCGGCGACCGAGTTGCTCTTGCCCGGCGTCAATACGGGATAA |
| TACCGCGCCACATAGCAGAACTTTAAAAGTGCTCATCATTGGAAAACGTT |
| CTTCGGGGCGAAAACTCTCAAGGATCTTACCGCTGTTGAGATCCAGTTCG |
| ATGTAACCCACTCGTGCACCCAACTGATCTTCAGCATCTTTTACTTTCAC |
| CAGCGTTTCTGGGTGAGCAAAAACAGGAAGGCAAAATGCCGCAAAAAAGG |
| GAATAAGGGCGACACGGAAATGTTGAATACTCATACTCTTCCTTTTTCAA |
| TATTATTGAAGCATTTATCAGGGTTATTGTCTCATGAGCGGATACATATT |
| TGAATGTATTTAGAAAAATAAACAAATAGGGGTTCCGCGCACATTTCCCC |
| GAAAAGTGCCACCTGACGTCGACGGATCGGGAGATCTCCCGATCCCCTAT |
| GGTGCACTCTCAGTACAATCTGCTCTGATGCCGCATAGTTAAGCCAGTAT |
| CTGCTCCCTGCTTGTGTGTTGGAGGTCGCTGAGTAGTGCGCGAGCAAAAT |
| TTAAGCTACAACAAGGCAAGGCTTGACCGACAATTGCATGAAGAATCTGC |
| TTAGGGTTAGGCGTTTTGCGCTGCTTCGCGATGTACGGGCCAGATATACG |
| CGTTGACATTGATTATTGACTAGTTATTAATAGTAATCAATTACGGGGTC |
| ATTAGTTCATAGCCCATATATGGAGTTCCGCGTTACATAACTTACGGTAA |

TABLE 21-continued

| Sequence of pcDNA3-EbCas12b |
|---|
| ATGGCCCGCCTGGCTGACCGCCCAACGACCCCCGCCCATTGACGTCAATA |
| ATGACGTATGTTCCCATAGTAACGCCAATAGGGACTTTCCATTGACGTCA |
| ATGGGTGGAGTATTTACGGTAAACTGCCCACTTGGCAGTACATCAAGTGT |
| ATCATATGCCAAGTACGCCCCCTATTGACGTCAATGACGGTAAATGGCCC |
| GCCTGGCATTATGCCCAGTACATGACCTTATGGGACTTTCCTACTTGGCA |
| GTACATCTACGTATTAGTCATCGCTATTACCATGGTGATGCGGTTTTGGC |
| AGTACATCAATGGGCGTGGATAGCGGTTTGACTCACGGGGATTTCCAAGT |
| CTCCACCCCATTGACGTCAATGGGAGTTTGTTTTGGCACCAAAATCAACG |
| GGACTTTCCAAAATGTCGTAACAACTCCGCCCCATTGACGCAAATGGGCG |
| GTAGGCGTGTACGGTGGGAGGTCTATATAAGCAGAGCTCTCTGGCTAACT |
| AGAGAACCCACTGCTTACTGGCTTATCGAAATTAATACGACTCACTATAG |
| GGAGACCCAAGCTGGCTAGCGTTTAAACTTAAGCTTGCCACCATGGCCCC |
| AAAGAAGAAGCGGAAGGTCGGTATCCACGGAGTCCCAGCAGCCGGATCCA |
| ACCGGATCTACCAGGGCAGAGTGACCAAGGTGGAAGTGCCCGATGGCAAG |
| GACGAGAAGGGCAACATCAAGTGGAAGAAGCTGGAAAATTGGAGCGACAT |
| CCTGTGGCAGCACCACATGCTGTTCCAGGACGCCGTGAACTACTACACAC |
| TGGCCCTGGCCGCCATCTCTGGATCTGCTGTTGGCAGCGACGAGAAGTCC |
| ATCATCCTGAGAGAATGGGCCGTGCAGGTCCAGAACATCTGGGAGAAAGC |
| CAAGAAAAAGGCCACCGTGTTCGAGGGCCCACAGAAGAGACTGACCAGCA |
| TCCTGGGCCTTGAGCAGAACGCCAGCTTCGACATTGCCGCCAAGCACATC |
| CTGAGGACCTCTGAGGCCAAGCCTGAGCAGAGAGCTAGCGCCCTGATCAG |
| ACTGCTGGAAGAGATCGACAAGAAAAACCACAACGTCGTGTGCGGCGAGC |
| GGCTGCCTTTTTTCTGCCCTCGGAACATCCAGAGCAAGCGGAGCCCTACA |
| AGCAAGGCCGTGTCTAGCGTGCAAGAGCAGAAACGGCAAGAGGAAGTGCG |
| GCGGTTCCACAACATGCAGCCTGAGGAAGTGGTCAAGAACGCCGTGACAC |
| TGGACATCAGCCTGTTCAAGAGCAGCCCCAAGATCGTGTTCCTGGAAGAT |
| CCCAAGAAGGCCAGAGCCGAGCTGCTGAAGCAGTTCGACAACGCCTGCAA |
| GAAACACAAAGAACTCGTGGGCATCAAGAAAGCCTTCACCGAGTCCATCG |
| ACAAGCACGGCTCTAGCCTGAAGGTGCCAGCTCCTGGCTCTAAGCCTAGC |
| GGCCTGTATCCTAGCGCCATCGTGTTCAAGTACTTCCCCGTGGATATTAC |
| CAAGACCGTGTTTCTGAAGGCCACAGAGAAGCTGGCCATGGGCAAAGACC |
| GGGAAGTGACCAACGATCCTATCGCCGACGCCAGAGTGAACGACAAGCCC |
| CACTTCGACTACTTCACCAACATTGCCCTGATCCGCGAGAAAGAGAAGAA |
| CAGAGCCGCTTGGTTTGAGTTCGATCTGGCCGCCTTTATCGAGGCCATCA |
| TGAGCCCTCACAGATTCTACCAGGACACCCAGAAGCGGAAAGAGGCCGCC |
| AGAAAGCTGGAAGAAAAGATCAAGGCCATCGAAGGCAAAGGCGGGCAGTT |
| CAAAGAGAGCGACAGCGAGGACGACGACGTGGACTCTCTGCCTGGATTTG |
| AGGGCGACACCAGAATCGACCTGCTGCGGAAGCTGGTCACCGATACACTT |
| GGATGGCTGGGCGAGAGCGAGACACCCGATAACAACGAGGGCAAAAAGAC |

TABLE 21-continued

| Sequence of pcDNA3-EbCas12b |
|---|
| CGAGTACAGCATCAGCGAGCGGACCCTGAGAATCTTCCCCGACATCCAGA |
| AGCAGTGGAGCGAGCTGGCCGAGAAAGGCGAGACAACAGAGGGAAAGCTG |
| CTCGAAGTGCTGAAACACGAGCAGACCGAGCACCAGAGCGATTTCGGAAG |
| CGCCACACTGTATCAGCACCTGGCCAAGCCAGAGTTTCACCCCATCTGGC |
| TGAAGTCCGGCACCGAGGAATGGCACGCCGAGAATCCTCTGAAAGCCTGG |
| CTGAACTACAAAGAGCTGCAGTACGAGCTGACCGACAAGAAGCGGCCCAT |
| CCACTTTACCCCTGCTCACCCTGTGTACAGCCCCAGATACTTCGACTTCC |
| CCAAGAAGTCCGAAACCGAAGAGAAAGAGGTGTCCAAGAACACCCACAGC |
| CTGACCACAAGCCTGGCCAGCGAGCACATCAAGAACTCCCTGCAGTTTAC |
| AGCCGGGCTGATCAGAAAGACCAACGTGGGCAAGAAGGCTATCAAGGCCC |
| GGTTCAGCTACAGCGCCCCTAGACTGAGAAGGGACTGCCTGAGAAGCGAG |
| AACAACGAGAACCTGTACAAGGCCCCTTGGCTCCAGCCTATGATGAGAGC |
| CCTGGGCATCGACGAGGAAAAGGCCGACAGACAGAACTTCGCCAACACCA |
| GGATCACCCTGATGGCCAAAGGCCTGGACGACATTCAGCTGGGCTTTCCC |
| GTGGAAGCCAACAGCCAAGAACTGCAGAAAGAAGTGTCTAACGGCATCAG |
| CTGGAAGGGCCAGTTCAACTGGGGAGGAATCGCCTCTCTGTCTGCCCTGA |
| GATGGCCCCACGAGAAGAAGCCCAAGAATCCTCCTGAGCAGCCTTGGTGG |
| GGCATCGATAGCTTTAGCTGCCTGGCCGTGGATCTGGGCCAGAGATATGC |
| TGGCGCCTTCGCCAGACTGGACGTGTCCACCATTGAGAAAAAGGGCAAGA |
| GCCGGTTCATCGGCGAGGCCTGCGACAAAAAGTGGTACGCCAAGGTGTCC |
| CGGATGGGCCTGTTGAGACTTCCTGGCGAGGACGTGAAAGTGTGGCGGGA |
| TGCCAGCAAGATTGACAAAGAGAACGGCTTCGCCTTCCGGAAAGAGCTGT |
| TCGGCGAGAAGGGAAGATCCGCCACACCTCTGGAAGCCGAGGAAACCGCC |
| GAGCTGATCAAGCTGTTTGGAGCCAACGAGAAGGACGTGATGCCCGACAA |
| CTGGTCTAAAGAGCTGAGCTTCCCCGAGCAGAATGACAAGCTGCTGATCG |
| TGGCTCGGAGAGCCCAGGCTGCTGTTAGCAGACTGCATAGATGGGCATGG |
| TTCTTCGACGAGGCCAAGAGATCCGACGACGCCATCAGAGAGATTCTGGA |
| AAGCGACGACACCGACCTGAAGCAGAAAGTGAACAAGAACGAGATCGAGA |
| AAGTCAAAGAGACAATCATCTCCCTGCTGAAAGTCAAGCAAGAGCTGCTG |
| CCCACACTGCTGACCAGACTGGCCAATAGAGTGCTGCCCCTGAGAGGCAG |
| ATCCTGGGAGTGGAAAAAGCACCACCAGAAGAACGACGGCTTCATCCTGG |
| ACCAGACCGGCAAGGCCATGCCTAACGTGCTGATTAGAGGACAGCGGGGC |
| CTGAGCATGGACCGGATCGAGCAGATTACCGAGCTGAGAAAGCGGTTTCA |
| GGCCCTGAACCAGAGCCTGCGGAGACAGATCGGAAAGAAGGCCCCTGCCA |
| AGCGGGACGACTCTATCCCTGATTGCTGCCCCGATCTGCTGGAAAAACTG |
| GACCACATGAAGGAACAGCGCGTGAACCAGACAGCCCACATGATTCTGGC |
| CGAGGCACTGGGACTGAAACTGGCCGAGCCTCCTAAGGACAAGAAAGAAC |
| TGAACGAGACATGCGACATGCACGGCGCCTACGCCAAAGTGGACAACCCC |
| GTGTCCTTCATCGTGATCGAGGACCTGAGCCGGTACAGAAGCAGCCAAGG |

TABLE 21-continued

| Sequence of pcDNA3-EbCas12b |
|---|
| CAGAAGCCCCAGAGAAAACAGCCGACTGATGAAGTGGTGCCACAGGGCCG |
| TCAGAGACAAGCTGAAAGAAATGTGCGAGGTGTTCTTCCCACTGTGCGAG |
| AGAAGAAAGGCCGGCTCTGCTTGGGTTTCCCTGCCTCCTCTGCTTGAAAC |
| ACCAGCCGCCTACAGCAGCAGATTCTGCAGCAGATCTGGCGTGGCCGGCT |
| TCAGAGCCGTGGAAGTGATTCCTGGCTTCGAGCTGAAGTACCCCTGGTCT |
| TGGCTGAAGGATAAGAAGGACAAGGCCGGCAATCTGGCCAAAGAAGCCCT |
| GAACATCCGGACCGTGTCTGAGCAGCTGAAGGCCTTTAACCAGGACAAGC |
| CCGAGAAGCCCAGGACACTGCTGGTGCCTATTGCCGGCGGACCTATCTTC |
| GTGCCCATCTCTGAAGTGGGCCTGTCCAGCTTCGGACTGAAGCCTCAGGT |
| TGTGCAGGCCGACATCAACGCCGCCATCAATCTGGGACTCAGAGCCATCA |
| GCGACCCTCGGATTTGGGAGATTCACCCCAGACTGCGGACCGAGAAGAGA |
| GATGGCAGACTGTTCGCCAGAGAGAAACGGAAGTACGGCGAAGAGAAGGT |
| CGAGGTGCAGCCCAGCAAGAATGAGAAGGCCAAAAAAGTGAAGGACGACC |
| GGAAGCCTAACTACTTCGCCGATTTCAGCGGCAAGGTGGACTGGGGCTTT |
| GGCAACATTAAGAACGAGTCCGGCCTGACACTGGTGTCTGGCAAAGCACT |
| GTGGTGGACCATCAACCAGCTGCAGTGGGAGAGATGCTTTGACATCAACA |
| AGCGGCACATCGAGGACTGGTCCAACAAGCAGAAGCAAGGATCCAAAAGG |
| CCGGCGGCCACGAAAAAGGCCGGCCAGGCAAAAAAGAAAAAGggatctTA |
| CCCATACGATGTTCCAGATTACGCTTATCCCTACGACGTGCCTGATTATG |
| CATACCCATATGATGTCCCCGACTATGCCtaaGAATTCTGCAGATATCCA |
| GCACAGTGGCGGCCGCTCGAGTCTAGAGGGCCCGTTTAAACCCGCTGATC |
| AGCCTCGACTGTGCCTTCTAGTTGCCAGCCATCTGTTGTTTGCCCCTCCC |
| CCGTGCCTTCCTTGACCCTGGAAGGTGCCACTCCCACTGTCCTTTCCTAA |
| TAAAATGAGGAAATTGCATCGCATTGTCTGAGTAGGTGTCATTCTATTCT |
| GGGGGGTGGGGTGGGGCAGGACAGCAAGGGGGAGGATTGGGAAGACAATA |
| GCAGGCATGCTGGGGATGCGGTGGGCTCTATGGCTTCTGAGGCGGAAAGA |
| ACCAGCTGGGGCTCTAGGGGGTATCCCCACGCGCCCTGTAGCGGCGCATT |
| AAGCGCGGCGGGTGTGGTGGTTACGCGCAGCGTGACCGCTACACTTGCCA |
| GCGCCCTAGCGCCCGCTCCTTTCGCTTTCTTCCCTTCCTTTCTCGCCACG |
| TTCGCCGGCTTTCCCCGTCAAGCTCTAAATCGGGGGCTCCCTTTAGGGTT |
| CCGATTTAGTGCTTTACGGCACCTCGACCCCAAAAAACTTGATTAGGGTG |
| ATGGTTCACGTAGTGGGCCATCGCCCTGATAGACGGTTTTTCGCCCTTTG |
| ACGTTGGAGTCCACGTTCTTTAATAGTGGACTCTTGTTCCAAACTGGAAC |
| AACACTCAACCCTATCTCGGTCTATTCTTTTGATTTATAAGGGATTTTGC |
| CGATTTCGGCCTATTGGTTAAAAAATGAGCTGATTTAACAAAAATTTAAC |
| GCGAATTAATTCTGTGGAATGTGTGTCAGTTAGGGTGTGGAAAGTCCCCA |
| GGCTCCCCAGCAGGCAGAAGTATGCAAAGCATGCATCTCAATTAGTCAGC |
| AACCAGGTGTGGAAAGTCCCCAGGCTCCCCAGCAGGCAGAAGTATGCAAA |
| GCATGCATCTCAATTAGTCAGCAACCATAGTCCCGCCCCTAACTCCGCCC |
| ATCCCGCCCCTAACTCCGCCCAGTTCCGCCCATTCTCCGCCCCATGGCTG |
| ACTAATTTTTTTTATTTATGCAGAGGCCGAGGCCGCCTCTGCCTCTGAGC |
| TATTCCAGAAGTAGTGAGGAGGCTTTTTTGGAGGCCTAGGCTTTTGCAAA |
| AAGCTCCCGGGAGCTTGTATATCCATTTTCGGATCTGATCAAGAGACAGG |
| ATGAGGATCGTTTCGCATGATTGAACAAGATGGATTGCACGCAGGTTCTC |
| CGGCCGCTTGGGTGGAGAGGCTATTCGGCTATGACTGGGCACAACAGACA |
| ATCGGCTGCTCTGATGCCGCCGTGTTCCGGCTGTCAGCGCAGGGGCGCCC |
| GGTTCTTTTTGTCAAGACCGACCTGTCCGGTGCCCTGAATGAACTGCAGG |
| ACGAGGCAGCGCGGCTATCGTGGCTGGCCACGACGGGCGTTCCTTGCGCA |
| GCTGTGCTCGACGTTGTCACTGAAGCGGGAAGGGACTGGCTGCTATTGGG |
| CGAAGTGCCGGGGCAGGATCTCCTGTCATCTCACCTTGCTCCTGCCGAGA |
| AAGTATCCATCATGGCTGATGCAATGCGGCGGCTGCATACGCTTGATCCG |
| GCTACCTGCCCATTCGACCACCAAGCGAAACATCGCATCGAGCGAGCACG |
| TACTCGGATGGAAGCCGGTCTTGTCGATCAGGATGATCTGGACGAAGAGC |
| ATCAGGGGCTCGCGCCAGCCGAACTGTTCGCCAGGCTCAAGGCGCGCATG |
| CCCGACGGCGAGGATCTCGTCGTGACCCATGGCGATGCCTGCTTGCCGAA |
| TATCATGGTGGAAAATGGCCGCTTTTCTGGATTCATCGACTGTGGCCGGC |
| TGGGTGTGGCGGACCGCTATCAGGACATAGCGTTGGCTACCCGTGATATT |
| GCTGAAGAGCTTGGCGGCGAATGGGCTGACCGCTTCCTCGTGCTTTACGG |
| TATCGCCGCTCCCGATTCGCAGCGCATCGCCTTCTATCGCCTTCTTGACG |
| AGTTCTTCTGAGCGGGACTCTGGGGTTCGAAATGACCGACCAAGCGACGC |
| CCAACCTGCCATCACGAGATTTCGATTCCACCGCCGCCTTCTATGAAAGG |
| TTGGGCTTCGGAATCGTTTTCCGGGACGCCGGCTGGATGATCCTCCAGCG |
| CGGGGATCTCATGCTGGAGTTCTTCGCCCACCCCAACTTGTTTATTGCAG |
| CTTATAATGGTTACAAATAAAGCAATAGCATCACAAATTTCACAAATAAA |
| GCATTTTTTTCACTGCATTCTAGTTGTGGTTTGTCCAAACTCATCAATGT |
| ATCTTATCATGTCTGTATACCGTCGACCTCTAGCTAGAGCTTGGCGTAAT |
| CATGGTCATAGCTGTTTCCTGTGTGAAATTGTTATCCGCTCACAATTCCA |
| CACAACATACGAGCCGGAAGCATAAAGTGTAAAGCCTGGGGTGCCTAATG |
| AGTGAGCTAACTCACATTAATTGCGTTGCGCTCACTGCCCGCTTTCCAGT |
| CGGGAAACCTGTCGTGCCAGCTGCATTAATGAATCGGCCAACGCGCGGGG |
| AGAGGCGGTTTGCGTATTGGGCGCTCTTCCGCTTCCTCGCTCACTGACTC |
| GCTGCGCTCGGTCGTTCGGCTGCGGCGAGCGGTATCAGCTCACTCAAAGG |
| CGGTAATACGGTTATCCACAGAATCAGGGGATAACGCAGGAA (SEQ ID NO: 582) |

Example 13

Figure 28:
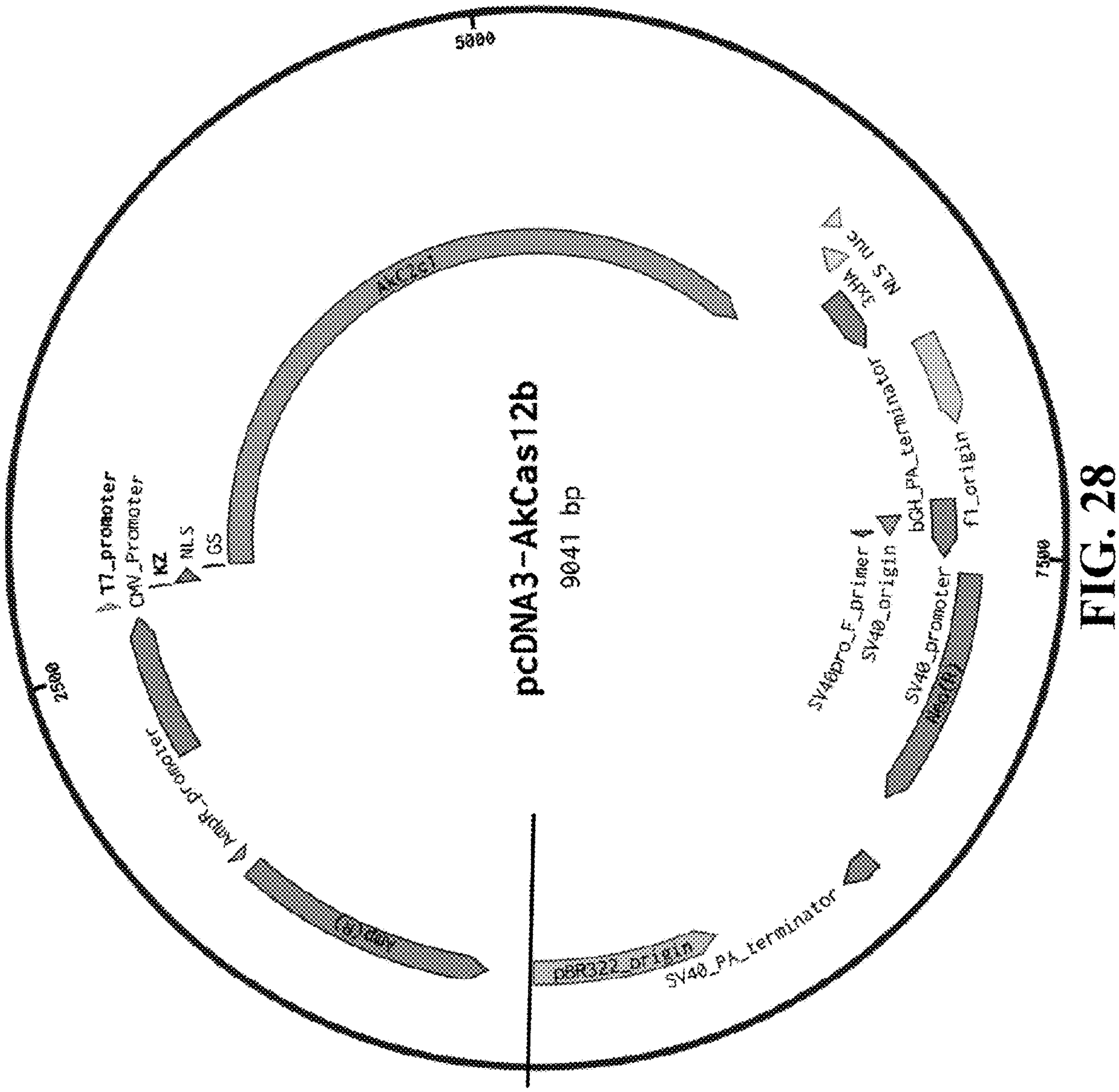
FIG. 28 shows a plasmid map of an exemplary construct containing AkCas12b.

AkCas12b (*Alicyclobacillus kakegawensis* Cas12b) was cloned into a plasmid (pcDNA3-AkCas12b). A map of the plasmid is shown in FIG. 28. The sequence of the cloned contract is shown in Table 22 below.

TABLE 22

| Sequence of pcDNA3-AkCas12b |
| --- |
| AGAACATGTGAGCAAAAGGCCAGCAAAAGGCCAGGAACCGTAAAAAGGCCGC |
| GTTGCTGGCGTTTTTCCATAGGCTCCGCCCCCCTGACGAGCATCACAAAAATCG |
| ACGCTCAAGTCAGAGGTGGCGAAACCCGACAGGACTATAAAGATACCAGGCG |
| TTTCCCCCTGGAAGCTCCCTCGTGCGCTCTCCTGTTCCGACCCTGCCGCTTACC |
| GGATACCTGTCCGCCTTTCTCCCTTCGGGAAGCGTGGCGCTTTCTCATAGCTCA |
| CGCTGTAGGTATCTCAGTTCGGTGTAGGTCGTTCGCTCCAAGCTGGGCTGTGTG |
| CACGAACCCCCCGTTCAGCCCGACCGCTGCGCCTTATCCGGTAACTATCGTCTT |
| GAGTCCAACCCGGTAAGACACGACTTATCGCCACTGGCAGCAGCCACTGGTAA |
| CAGGATTAGCAGAGCGAGGTATGTAGGCGGTGCTACAGAGTTCTTGAAGTGGT |
| GGCCTAACTACGGCTACACTAGAAGAACAGTATTTGGTATCTGCGCTCTGCTG |
| AAGCCAGTTACCTTCGGAAAAAGAGTTGGTAGCTCTTGATCCGGCAAACAAAC |
| CACCGCTGGTAGCGGTGGTTTTTTTGTTTGCAAGCAGCAGATTACGCGCAGAA |
| AAAAAGGATCTCAAGAAGATCCTTTGATCTTTTCTACGGGGTCTGACGCTCAGT |
| GGAACGAAAACTCACGTTAAGGGATTTTGGTCATGAGATTATCAAAAAGGATC |
| TTCACCTAGATCCTTTTAAATTAAAAATGAAGTTTTAAATCAATCTAAAGTATA |
| TATGAGTAAACTTGGTCTGACAGTTACCAATGCTTAATCAGTGAGGCACCTATC |
| TCAGCGATCTGTCTATTTCGTTCATCCATAGTTGCCTGACTCCCCGTCGTGTAG |
| ATAACTACGATACGGGAGGGCTTACCATCTGGCCCCAGTGCTGCAATGATACC |
| GCGAGACCCACGCTCACCGGCTCCAGATTTATCAGCAATAAACCAGCCAGCCG |
| GAAGGGCCGAGCGCAGAAGTGGTCCTGCAACTTTATCCGCCTCCATCCAGTCT |
| ATTAATTGTTGCCGGGAAGCTAGAGTAAGTAGTTCGCCAGTTAATAGTTTGCG |
| CAACGTTGTTGCCATTGCTACAGGCATCGTGGTGTCACGCTCGTCGTTTGGTAT |
| GGCTTCATTCAGCTCCGGTTCCCAACGATCAAGGCGAGTTACATGATCCCCCAT |
| GTTGTGCAAAAAAGCGGTTAGCTCCTTCGGTCCTCCGATCGTTGTCAGAAGTA |
| AGTTGGCCGCAGTGTTATCACTCATGGTTATGGCAGCACTGCATAATTCTCTTA |
| CTGTCATGCCATCCGTAAGATGCTTTTCTGTGACTGGTGAGTACTCAACCAAGT |
| CATTCTGAGAATAGTGTATGCGGCGACCGAGTTGCTCTTGCCCGGCGTCAATA |
| CGGGATAATACCGCGCCACATAGCAGAACTTTAAAAGTGCTCATCATTGGAAA |
| ACGTTCTTCGGGGCGAAAACTCTCAAGGATCTTACCGCTGTTGAGATCCAGTTC |
| GATGTAACCCACTCGTGCACCCAACTGATCTTCAGCATCTTTTACTTTCACCAG |
| CGTTTCTGGGTGAGCAAAAACAGGAAGGCAAAATGCCGCAAAAAAGGGAATA |
| AGGGCGACACGGAAATGTTGAATACTCATACTCTTCCTTTTTCAATATTATTGA |
| AGCATTTATCAGGGTTATTGTCTCATGAGCGGATACATATTTGAATGTATTTAG |
| AAAAATAAACAAATAGGGGTTCCGCGCACATTTCCCCGAAAAGTGCCACCTGA |
| CGTCGACGGATCGGGAGATCTCCCGATCCCCTATGGTGCACTCTCAGTACAAT |
| CTGCTCTGATGCCGCATAGTTAAGCCAGTATCTGCTCCCTGCTTGTGTGTTGGA |
| GGTCGCTGAGTAGTGCGCGAGCAAAATTTAAGCTACAACAAGGCAAGGCTTGA |
| CCGACAATTGCATGAAGAATCTGCTTAGGGTTAGGCGTTTTGCGCTGCTTCGCG |
| ATGTACGGGCCAGATATACGCGTTGACATTGATTATTGACTAGTTATTAATAGT |

TABLE 22-continued

| Sequence of pcDNA3-AkCas12b |
|---|
| AATCAATTACGGGGTCATTAGTTCATAGCCCATATATGGAGTTCCGCGTTACAT |
| AACTTACGGTAAATGGCCCGCCTGGCTGACCGCCCAACGACCCCCGCCCATTG |
| ACGTCAATAATGACGTATGTTCCCATAGTAACGCCAATAGGGACTTTCCATTG |
| ACGTCAATGGGTGGAGTATTTACGGTAAACTGCCCACTTGGCAGTACATCAAG |
| TGTATCATATGCCAAGTACGCCCCCTATTGACGTCAATGACGGTAAATGGCCC |
| GCCTGGCATTATGCCCAGTACATGACCTTATGGGACTTTCCTACTTGGCAGTAC |
| ATCTACGTATTAGTCATCGCTATTACCATGGTGATGCGGTTTTGGCAGTACATC |
| AATGGGCGTGGATAGCGGTTTGACTCACGGGGATTTCCAAGTCTCCACCCCAT |
| TGACGTCAATGGGAGTTTGTTTTGGCACCAAAATCAACGGGACTTTCCAAAAT |
| GTCGTAACAACTCCGCCCCATTGACGCAAATGGGCGGTAGGCGTGTACGGTGG |
| GAGGTCTATATAAGCAGAGCTCTCTGGCTAACTAGAGAACCCACTGCTTACTG |
| GCTTATCGAAATTAATACGACTCACTATAGGGAGACCCAAGCTGGCTAGCGTT |
| TAAACTTAAGCTTGCCACCATGGCCCCAAAGAAGAAGCGGAAGGTCGGTATCC |
| ACGGAGTCCCAGCAGCCGGATCCgccgtgaagtccatcaaagtgaagagcggctgagcgagtgccccga |
| tattctggctggaatgtggcagctgcacagagccacaaatgccggcgtgcggtactacacagaatgggtgtccctgat |
| gcggcaagagatcctgtacagcagaggccctgatggcggccagcagtgttatatgaccgccgaggattgccagagaga |
| gctgctgcggagactgcggaatagacagctgcataacggccggcaggatcagcctggaacagatgctgatctgctggc |
| catcagcagacggctgtacgagattctggtgctgcagagcatcggcaaaagaggcgacgcccagcagattgccagcag |
| ctttctgagccctctggtggaccccaacagcaaaggtggaagaggcgaggccaagagcggaagaaaacctgcctggca |
| gaagatgcgcgaccagggcgatcctagatgggttgccgctagagagaagtacgagcagcggaaggccgtggatcccag |
| caaagagattctgaacagcctggacgccctgggcctcagacctctgtttgccgtgttcaccgagacatacagatccgg |
| cgtggactggaagcctctgggcaaatctcagggcgtcagaacctgggacagagacatgtttcagcaggccctggaacg |
| gctgatgagctgggagagctggaatcggagagtgggcgaagagtacgccagactgttccagcagaaaatgaagttcga |
| gcaagagcacttcgccgagcagagccacctggtcaaactggctagagccctggaagccgatatgagagccgcctctca |
| gggcttcgaggccaaaagaggaacagcccaccagatcaccagaagggcactgagaggggccgacagagtgttcgagat |
| ctggaagtctatccccgaggaagccagttcagccagtacgacgaagtgatcagacaggtgcaggccgagaagcggaga |
| gatttcggcagccatgacctgttcgccaagctggccgagcctaagtatcagcccctttggagagccgacgagacattc |
| ctgaccagatacgccagtacaacggcgtgctgcgcgatctggaaaaggccagacagttcgccaccttcacactgcctg |
| atgcctgcgtgaaccccatctggaccagattcgagtctagccagggcagcaacctgcacaaatacgagtttctgttcg |
| accacctcggacctggcagacacgccgtcagatttcagagactgctggtggtggaaagcgagggcgccaaagaaaggg |
| atagcgtggtggtgcctgtggctccttctggccaactggataagctggtgctgagggaagaagagaagtccagcgtcg |
| ccagcatctgcacgataccgctagacccgatggcttcatggctgaatgggctggcgccaaactgcagtacgagagaag |
| caccctggccagaaaagccagacgggacaagcagggcatgagaagctggcggagacagccctccatgctgatgtctgc |
| cgctcagatgctggaagatgccaaacaggctggcgacgtgtacctgaacatcagcgtgcgcgtgaagtctcccagtga |
| agtgcgaggacagaggcggcctccttacgccgctctgtttagaatcgacgacaagcagcggagagtgaccgtgaacta |
| caacaagctgagcgcctacctggaagaacaccccgataagcagatccctggcgctcctggactgctgtctggactgag |
| agtgatgtccgtggacctgggcctgagaacaagcgccagcatctccgtgttcagagtggccaagaaagaagaggtgga |
| agccctcggagatggccggcctcctcactactatcctatccacggcaccgatgacctggtggccgtgcacgaaagatc |
| ccacctgattcagatgcccggcgaaaccgagacaaagcagctgcggaagctgagagaagaacggcaggccgtgctgag |

TABLE 22-continued

| Sequence of pcDNA3-AkCas12b |
|---|
| gccactgtttgctcaactggcactgctgagactgctcgtcagatgtggcgccgctgacgagagaatcagaaccagatc |
| ctggcagcggctgaccaagcagggaagagagttcaccaagagactgacccctagctggcgcgaggctctggaactgga |
| actgacaagactcgaggcctactgcggcagagtgcccgatgatgagtggtccagaatcgtggacagaaccgtgattgc |
| cagtggcggagaatgggcaagcaagtgcgcgattggcggaagcaagtgaagtccggggccaaagtgaaagtgaagggc |
| taccagctggatgtcgtcggcggaaattctctggcccagatcgactatctggaacagcagtacaagttcctgcggcgt |
| tggagcttcttcgccagagcttctggcctggtcgtgcgggccgatagagaaagccattttgccgtggctctgagacag |
| cacatcgagaacgccaagcgggacagactgaagaaactggccgaccggatcctgatggaagcactgggctatgtgtac |
| gaggccagcggacctagagaaggccagtggacagctcagcaccctccttgccagctgatcattctcgaggaactgtcc |
| gcctaccggttcagcgacgatagacctcctagcgagaacagcaaactgatggcctggggccacagaggcatcctcgaa |
| gaactggtcaaccaggctcaggtgcacgatgtgctcgtgggcacagtgtacgccgccttcagcagcagattcgacgct |
| agaacaggtgctcccggcgtcagatgcagaagagtgcctgccagatttgtgggcgccaccgtggatgattctctgcca |
| ctgtggctgaccgagttcctggacaagcaccggctggataagaacctgctgcggcccgacgatgtgatcccaacaggc |
| gaaggcgaattcctggtgtccccttgtggcgaagaggctgccagagttagacaggttcacgccgacatcaacgctgcc |
| cagaacctgcagagaaggctgtggcagaacttcgacatcaccgagagaggctgagatgcgacgtgaagatgggcggag |
| agggaacagtgctggtgcccagagtgaacaacgccagagccaagcagctgttcggcaagaaggtgctggtttcccagg |
| acggcgtgaccttcttcgagagatctcagacaggcggcaagccccacagcgagaagcagaccgatctgaccgacaaag |
| aactcgagctgatcgccgaggccgatgaggccagagctaaaagcgtggtgctgttcagggatcctagcggccacattg |
| gcaaaggccactggatccggcagcgcgagttttggagtctggtcaagcagaggatcgagagccacaccgccgagc |
| ggattagagttagaggcgtgggaagctccctggacGGATCCAAAAGGCCGGCGGCCACGAAAAAG |
| GCCGGCCAGGCAAAAAAGAAAAAGggatctTACCCATACGATGTTCCAGATTACG |
| CTTATCCCTACGACGTGCCTGATTATGCATACCCATATGATGTCCCCGACTATG |
| CCtaaGAATTCTGCAGATATCCAGCACAGTGGCGGCCGCTCGAGTCTAGAGGGC |
| CCGTTTAAACCCGCTGATCAGCCTCGACTGTGCCTTCTAGTTGCCAGCCATCTG |
| TTGTTTGCCCCTCCCCCGTGCCTTCCTTGACCCTGGAAGGTGCCACTCCCACTG |
| TCCTTTCCTAATAAAATGAGGAAATTGCATCGCATTGTCTGAGTAGGTGTCATT |
| CTATTCTGGGGGGTGGGGTGGGGCAGGACAGCAAGGGGGAGGATTGGGAAGA |
| CAATAGCAGGCATGCTGGGGATGCGGTGGGCTCTATGGCTTCTGAGGCGGAAA |
| GAACCAGCTGGGGCTCTAGGGGGTATCCCCACGCGCCCTGTAGCGGCGCATTA |
| AGCGCGGCGGGTGTGGTGGTTACGCGCAGCGTGACCGCTACACTTGCCAGCGC |
| CCTAGCGCCCGCTCCTTTCGCTTTCTTCCCTTCCTTTCTCGCCACGTTCGCCGGC |
| TTTCCCCGTCAAGCTCTAAATCGGGGGCTCCCTTTAGGGTTCCGATTTAGTGCT |
| TTACGGCACCTCGACCCCAAAAAACTTGATTAGGGTGATGGTTCACGTAGTGG |
| GCCATCGCCCTGATAGACGGTTTTTCGCCCTTTGACGTTGGAGTCCACGTTCTT |
| TAATAGTGGACTCTTGTTCCAAACTGGAACAACACTCAACCCTATCTCGGTCTA |
| TTCTTTTGATTTATAAGGGATTTTGCCGATTTCGGCCTATTGGTTAAAAAATGA |
| GCTGATTTAACAAAAATTTAACGCGAATTAATTCTGTGGAATGTGTGTCAGTTA |
| GGGTGTGGAAAGTCCCCAGGCTCCCCAGCAGGCAGAAGTATGCAAAGCATGC |
| ATCTCAATTAGTCAGCAACCAGGTGTGGAAAGTCCCCAGGCTCCCCAGCAGGC |
| AGAAGTATGCAAAGCATGCATCTCAATTAGTCAGCAACCATAGTCCCGCCCCT |

TABLE 22-continued

| Sequence of pcDNA3-AkCas12b |
| --- |
| AACTCCGCCCATCCCGCCCCTAACTCCGCCCAGTTCCGCCCATTCTCCGCCCCA |
| TGGCTGACTAATTTTTTTTATTTATGCAGAGGCCGAGGCCGCCTCTGCCTCTGA |
| GCTATTCCAGAAGTAGTGAGGAGGCTTTTTTGGAGGCCTAGGCTTTTGCAAAA |
| AGCTCCCGGGAGCTTGTATATCCATTTTCGGATCTGATCAAGAGACAGGATGA |
| GGATCGTTTCGCATGATTGAACAAGATGGATTGCACGCAGGTTCTCCGGCCGC |
| TTGGGTGGAGAGGCTATTCGGCTATGACTGGGCACAACAGACAATCGGCTGCT |
| CTGATGCCGCCGTGTTCCGGCTGTCAGCGCAGGGGCGCCCGGTTCTTTTTGTCA |
| AGACCGACCTGTCCGGTGCCCTGAATGAACTGCAGGACGAGGCAGCGCGGCTA |
| TCGTGGCTGGCCACGACGGGCGTTCCTTGCGCAGCTGTGCTCGACGTTGTCACT |
| GAAGCGGGAAGGGACTGGCTGCTATTGGGCGAAGTGCCGGGGCAGGATCTCC |
| TGTCATCTCACCTTGCTCCTGCCGAGAAAGTATCCATCATGGCTGATGCAATGC |
| GGCGGCTGCATACGCTTGATCCGGCTACCTGCCCATTCGACCACCAAGCGAAA |
| CATCGCATCGAGCGAGCACGTACTCGGATGGAAGCCGGTCTTGTCGATCAGGA |
| TGATCTGGACGAAGAGCATCAGGGGCTCGCGCCAGCCGAACTGTTCGCCAGGC |
| TCAAGGCGCGCATGCCCGACGGCGAGGATCTCGTCGTGACCCATGGCGATGCC |
| TGCTTGCCGAATATCATGGTGGAAAATGGCCGCTTTTCTGGATTCATCGACTGT |
| GGCCGGCTGGGTGTGGCGGACCGCTATCAGGACATAGCGTTGGCTACCCGTGA |
| TATTGCTGAAGAGCTTGGCGGCGAATGGGCTGACCGCTTCCTCGTGCTTTACGG |
| TATCGCCGCTCCCGATTCGCAGCGCATCGCCTTCTATCGCCTTCTTGACGAGTT |
| CTTCTGAGCGGGACTCTGGGGTTCGAAATGACCGACCAAGCGACGCCCAACCT |
| GCCATCACGAGATTTCGATTCCACCGCCGCCTTCTATGAAAGGTTGGGCTTCGG |
| AATCGTTTTCCGGGACGCCGGCTGGATGATCCTCCAGCGCGGGGATCTCATGC |
| TGGAGTTCTTCGCCCACCCCAACTTGTTTATTGCAGCTTATAATGGTTACAAAT |
| AAAGCAATAGCATCACAAATTTCACAAATAAAGCATTTTTTTCACTGCATTCTA |
| GTTGTGGTTTGTCCAAACTCATCAATGTATCTTATCATGTCTGTATACCGTCGA |
| CCTCTAGCTAGAGCTTGGCGTAATCATGGTCATAGCTGTTTCCTGTGTGAAATT |
| GTTATCCGCTCACAATTCCACACAACATACGAGCCGGAAGCATAAAGTGTAAA |
| GCCTGGGGTGCCTAATGAGTGAGCTAACTCACATTAATTGCGTTGCGCTCACTG |
| CCCGCTTTCCAGTCGGGAAACCTGTCGTGCCAGCTGCATTAATGAATCGGCCA |
| ACGCGCGGGGAGAGGCGGTTTGCGTATTGGGCGCTCTTCCGCTTCCTCGCTCAC |
| TGACTCGCTGCGCTCGGTCGTTCGGCTGCGGCGAGCGGTATCAGCTCACTCAA |
| AGGCGGTAATACGGTTATCCACAGAATCAGGGGATAACGCAGGAA<br>(SEQ ID NO: 583) |

Example 14

Figure 29:
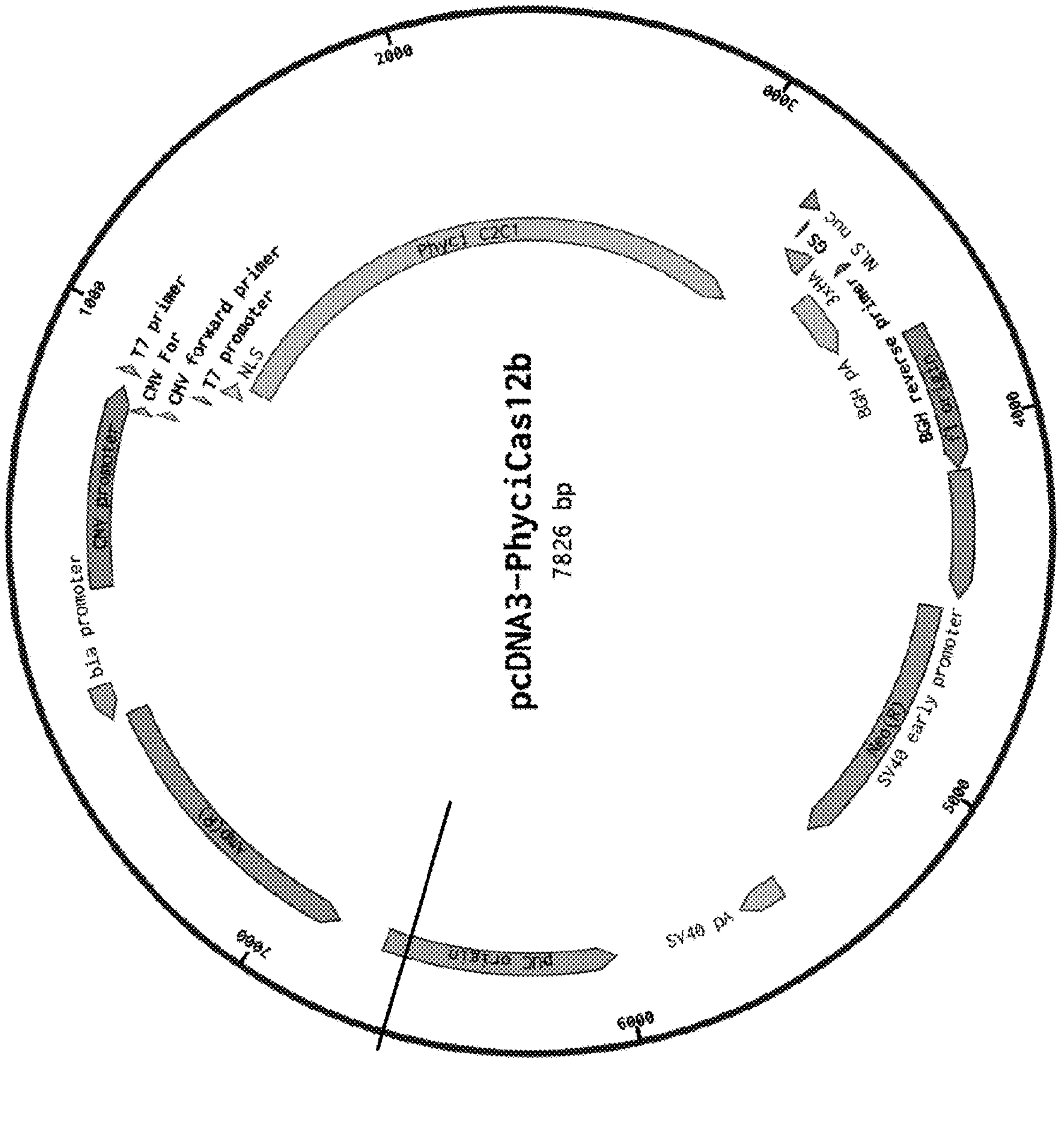
FIG. 29 shows a plasmid map of an exemplary construct containing PhyciCas12b.

PhyciCas12b (Phycisphaerae bacterium Cas12b) was cloned into a plasmid (pcDNA3-PhyciCas12b). A map of the plasmid is shown in FIG. 29. The sequence of the cloned construct is shown in Table 23 below.

TABLE 23

| Sequence of pcDNA3-PhyciCas12b |
|---|
| gacggatcgggagatctcccgatcccctatggtgcactctcagtacaatctgctctgatgccgcatagttaagccagt |
| atctgctccctgcttgtgtgttggaggtcgctgagtagtgcgcgagcaaaatttaagctacaacaaggcaaggcttga |
| ccgacaattgcatgaagaatctgcttagggttaggcgttttgcgctgcttcgcgatgtacgggccagatatacgcgtt |
| gacattgattattgactagttattaatagtaatcaattacggggtcattagttcatagcccatatatggagttccgcg |
| ttacataacttacggtaaatggcccgcctggctgaccgcccaacgacccccgcccattgacgtcaataatgacgtatg |
| ttcccatagtaacgccaatagggactttccattgacgtcaatgggtggagtatttacggtaaactgcccacttggcag |
| tacatcaagtgtatcatatgccaagtacgccccctattgacgtcaatgacggtaaatggcccgcctggcattatgccc |
| agtacatgaccttatgggactttcctacttggcagtacatctacgtattagtcatcgctattaccatggtgatgcggt |
| tttggcagtacatcaatgggcgtggatagcggtttgactcacggggatttccaagtctccaccccattgacgtcaatg |
| ggagtttgttttggcaccaaaatcaacgggactttccaaaatgtcgtaacaactccgccccattgacgcaaatgggcg |
| gtaggcgtgtacggtgggaggtctatataagcagagctctctggctaactagagaacccactgcttactggcttatcg |
| aaattaatacgactcactatagggagacccaagctggctagcgtttaaacttaagcttgccacc |
| ATGGCCCCAAAGAAGAAGCGGAAGGTC |
| GGTATCCACGGAGTCCCAGCAGCCGCCACCAAGAGCTACAGAGCCAGAATCCT |
| GACCGACAGCAGACTGGCCGCTGCTCTGGATAGAACCCACGTGGTGTTTGTGG |
| AAAGCCTGAAGCAGATGATCAACACCTACCTGCGGATGCAGAACGGCAAGTTC |
| GGCCCCGACCACAAGAAACTGGCCCAGATCATGCTGAGCCGGTCCAACACATT |
| TGCCCACGGCGTGATGGACCAGATCACCAGAGATCAGCCCACCAGCACACTGG |
| ACGAGGAATGGACCGACCTGGCCAGAAGAATCCACAAGACAACCGGACCTCT |
| GTTCCTGCAAGCCGAGAGATTCGCCACCGTGAAGAACAGAGCCATCCACACCA |
| AGTCCAGAGGCAAAGTGATCCCATCTCCTGAGACACTGGCCGTGCCTGCCAAG |
| TTCTGGCACCAAGTGTGCGATAGCGCCAGCGCCTACATCAGATCCAACCGCGA |
| ACTGATGCAGCAGTGGCGGAAAGATAGAGCCGCCTGGCTGAAGGACAAGAAC |
| GAGTGGCAGCAGAAACACCCCGAGTTCATGCAGTTCTACAACGGCCCCTACCA |
| GAACTTCCTGAAGCTGTGCGACGACGACAGAATCACCTCTCAGCTGGCTGCCG |
| AGCAGCAGCCTACAGCCAGCAAGAACAACAGACCCAGAAAGACCGGCAAGCG |
| CTTCGCCAGATGGCACCTGTGGTACAAGTGGCTGAGCGAGAACCCCGAGATCA |
| TCGAATGGCGGAACAAGGCCTCCGCCAGCGACTTTAAGACCGTGACCGATGAC |
| GTGCGGAAGCAGATCATTACCAAGTATCCCCAGCAGAACAAGTACATCACCCG |
| GCTGCTGGACTGGCTGGAAGATAACAACCCCGAGCTGAAAACCCTGGAAAAC |
| CTGCGGCGGACCTACGTGAAGAAGTTCGACAGCTTCAAGCGGCCTCCTACACT |
| GACCCTGCCATCTCCATACAGACACCCCTACTGGTTCACCATGGAACTGGACC |
| AGTTTTACAAGAAGGCCGACTTCGAGAACGGCACCATCCAGCTGCTGCTGATC |
| GACGAGGACGACGACGGCAACTGGTTCTTCAACTGGATGCCCGCCTCTCTGAA |
| GCCCGATCCTAGACTGGTGCCTTCTTGGAGAGCCGAAACCTTCGAGACAGAGG |

TABLE 23-continued

| Sequence of pcDNA3-PhyciCas12b |
| --- |
| GCAGATTCCCTCCTTACCTCGGCGGCAAGATCGGCAAGAAGCTGAGCAGACCT |
| GCTCCTACCGACGCCGAGAGAAAGGCTGGAATTGCCGGCGCTAAGCTGATGAT |
| TAAGAACAATCGGAGCGAGCTGCTGTTCACCGTGTTCGAGCAGGACTGCCCTC |
| CTAGAGTGAAGTGGGCCAAGACCAAGAACCGGAAGTGCCCTGCCGACAACGC |
| CTTTAGCTCCGACGGCAAGACCAGAAAGCCCCTGAGAATCCTGTCCATCGACC |
| TGGGCATCAGACACATCGGCGCCTTCGCTCTGACACAGGGCACCAGAAATGAT |
| AGCGCCTGGCAGACCGAGAGCCTGAAGAAGGGCATCATCAACAGCCCTAGCA |
| TCCCTCCACTGCGGCAAGTGCGGAGACACGACTACGACCTGAAGCGGAAAAG |
| ACGGCGGCACGGCAAGCCTGTGAAGGGCCAGAGAAGCAACGCCAATCTGCAG |
| GCCCACAGGACCAACATGGCCCAGGACAGATTCAAGAAGGGCGCCTCTGCCAT |
| CGTGTCACTGGCCAGAGAGCATAGCGCCGACCTGATCCTGTTCGAGAACCTGC |
| ACAGCCTGAAGTTCAGCGCCTTCGACGAGCGGTGGATGAACAGACAGCTGCGG |
| GACATGAACCGGCGGCACATCGTGGAACTGGTGTCTGAACAGGCCCCTGAGTT |
| CGGCATCACAGTGAAGGACGACATCAACCCCTGGATGACCAGCCGGATCTGCA |
| GCAACTGTAACCTGCCTGGCTTCAGGTTCAGCATGAAGAAGAAGAACCCCTAC |
| CGCGAGAAGCTGCCCAGAGAGAAGTGCACCGATTTCGGCTACCCTGTGTGGGA |
| ACCTGGCGGCCACCTGTTTAGATGCCCTCACTGCGACCACAGAGTGAACGCCG |
| ACATTAACGCCGCTGCCAACCTGGCCAACAAGTTCTTTGGCCTCGGCTACTGG |
| AACAACGGCCTGAAGTACGATGCCGAGACAAAGACCTTCACCGTGCACACCG |
| ACAAGAAAACCCCACCTCTGATCTTCAAGCCCAGACCTCAGTTCGATCTGTGG |
| GCCGACAGCGTGAAAACACGGAAGCAGCTTGGCCCCGATCCTTTCAAAAGGCC |
| GGCGGCCACGAAAAAGGCCGGCCAGGCAAAAAAGAAAAAGGGATCCTACCCA |
| TACGATGTTCCAGATTACGCTTATCCCTACGACGTGCCTGATTATGCATACCCA |
| TATGATGTCCCCGACTATGCCTAAGaattctgcagatatccagcacagtggcggccgctcgagtctagagg |
| gcccgtttaaacccgctgatcagcctcgactgtgccttctagttgccagccatctgttgtttgcccctcccccgtgcc |
| ttccttgaccctggaaggtgccactcccactgtcctttcctaataaaatgaggaaattgcatcgcattgtagagtagg |
| tgtcattctattctggggggtggggtggggcaggacagcaagggggaggattgggaagacaatagcaggcatgctggg |
| gatgcggtgggctctatggcttctgaggcggaaagaaccagctggggctctagggggtatccccacgcgccctgtagc |
| ggcgcattaagcgcggcgggtgtggtggttacgcgcagcgtgaccgctacacttgccagcgccctagcgcccgctcct |
| ttcgctttcttcccttcctttctcgccacgttcgccggctttccccgtcaagctctaaatcgggggctccctttaggg |
| ttccgatttagtgctttacggcacctcgaccccaaaaaacttgattagggtgatggttcacgtagtgggccatcgccc |
| tgatagacggtttttcgccctttgacgttggagtccacgttctttaatagtggactcttgttccaaactggaacaaca |
| ctcaaccctatctcggtctattcttttgatttataagggattttgccgatttcggcctattggttaaaaaatgagctg |
| atttaacaaaaatttaacgcgaattaattctgtggaatgtgtgtcagttagggtgtggaaagtccccaggctccccag |
| caggcagaagtatgcaaagcatgcatctcaattagtcagcaaccaggtgtggaaagtccccaggctccccagcaggca |
| gaagtatgcaaagcatgcatctcaattagtcagcaaccatagtcccgcccctaactccgcccatcccgcccctaactc |
| cgcccagttccgcccattctccgccccatggctgactaattttttttatttatgcagaggccgaggccgcctctgcct |
| ctgagctattccagaagtagtgaggaggcttttttggaggcctaggcttttgcaaaaagctcccgggagcttgtatat |
| ccattttcggatctgatcaagagacaggatgaggatcgtttcgcatgattgaacaagatggattgcacgcaggttctc |

TABLE 23-continued

| Sequence of pcDNA3-PhyciCas12b |
| --- |
| cggccgcttgggtggagaggctattcggctatgactgggcacaacagacaatcggctgctctgatgccgccgtgttcc |
| ggctgtcagcgcaggggcgcccggttctttttgtcaagaccgacctgtccggtgccctgaatgaactgcaggacgagg |
| cagcgcggctatcgtggctggccacgacgggcgttccttgcgcagctgtgctcgacgttgtcactgaagcgggaaggg |
| actggctgctattgggcgaagtgccggggcaggatctcctgtcatctcaccttgctcctgccgagaaagtatccatca |
| tggctgatgcaatgcggcggctgcatacgcttgatccggctacctgcccattcgaccaccaagcgaaacatcgcatcg |
| agcgagcacgtactcggatggaagccggtcttgtcgatcaggatgatctggacgaagagcatcaggggctcgcgccag |
| ccgaactgttcgccaggctcaaggcgcgcatgcccgacggcgaggatctcgtcgtgacccatggcgatgcctgcttgc |
| cgaatatcatggtggaaaatggccgcttttctggattcatcgactgtggccggctgggtgtggcggaccgctatcagg |
| acatagcgttggctacccgtgatattgctgaagagcttggcggcgaatgggctgaccgcttcctcgtgctttacggta |
| tcgccgctcccgattcgcagcgcatcgccttctatcgccttcttgacgagttcttctgagcgggactctggggttcga |
| aatgaccgaccaagcgacgcccaacctgccatcacgagatttcgattccaccgccgccttctatgaaaggttgggctt |
| cggaatcgttttccgggacgccggctggatgatcctccagcgcggggatctcatgctggagttcttcgcccaccccaa |
| cttgtttattgcagcttataatggttacaaataaagcaatagcatcacaaatttcacaaataaagcatttttttcact |
| gcattctagttgtggtttgtccaaactcatcaatgtatcttatcatgtctgtataccgtcgacctctagctagagctt |
| ggcgtaatcatggtcatagctgtttcctgtgtgaaattgttatccgctcacaattccacacaacatacgagccggaag |
| cataaagtgtaaagcctggggtgcctaatgagtgagctaactcacattaattgcgttgcgctcactgcccgctttcca |
| gtcgggaaacctgtcgtgccagctgcattaatgaatcggccaacgcgcggggagaggcggtttgcgtattgggcgctc |
| ttccgcttcctcgctcactgactcgctgcgctcggtcgttcggctgcggcgagcggtatcagctcactcaaaggcggt |
| aatacggttatccacagaatcaggggataacgcaggaaagaacatgtgagcaaaaggccagcaaaaggccaggaaccg |
| taaaaaggccgcgttgctggcgtttttccataggctccgcccccctgacgagcatcacaaaaatcgacgctcaagtca |
| gaggtggcgaaacccgacaggactataaagataccaggcgtttccccctggaagctccctcgtgcgctctcctgttcc |
| gaccctgccgcttaccggatacctgtccgcctttctcccttcgggaagcgtggcgctttctcatagctcacgctgtag |
| gtatctcagttcggtgtaggtcgttcgctccaagctgggctgtgtgcacgaaccccccgttcagcccgaccgctgcgc |
| cttatccggtaactatcgtcttgagtccaacccggtaagacacgacttatcgccactggcagcagccactggtaacag |
| gattagcagagcgaggtatgtaggcggtgctacagagttcttgaagtggtggcctaactacggctacactagaagaac |
| agtatttggtatctgcgctctgctgaagccagttaccttcggaaaaagagttggtagctcttgatccggcaaacaaac |
| caccgctggtagcggtttttttgtttgcaagcagcagattacgcgcagaaaaaaaggatctcaagaagatcctttgat |
| cttttctacggggtctgacgctcagtggaacgaaaactcacgttaagggattttggtcatgagattatcaaaaaggat |
| cttcacctagatccttttaaattaaaaatgaagttttaaatcaatctaaagtatatatgagtaaacttggtctgacag |
| ttaccaatgcttaatcagtgaggcacctatctcagcgatctgtctatttcgttcatccatagttgcctgactccccgt |
| cgtgtagataactacgatacgggagggcttaccatctggccccagtgctgcaatgataccgcgagacccacgctcacc |
| ggctccagatttatcagcaataaaccagccagccggaagggccgagcgcagaagtggtcctgcaactttatccgcctc |
| catccagtctattaattgttgccgggaagctagagtaagtagttcgccagttaatagtttgcgcaacgttgttgccat |
| tgctacaggcatcgtggtgtcacgctcgtcgtttggtatggcttcattcagctccggttcccaacgatcaaggcgagt |
| tacatgatcccccatgttgtgcaaaaaagcggttagctccttcggtcctccgatcgttgtcagaagtaagttggccgc |
| agtgttatcactcatggttatggcagcactgcataattctcttactgtcatgccatccgtaagatgcttttctgtgac |
| tggtgagtactcaaccaagtcattctgagaatagtgtatgcggcgaccgagttgctcttgcccggcgtcaatacggga |
| taataccgcgccacatagcagaactttaaaagtgctcatcattggaaaacgttcttcggggcgaaaactctcaaggat |
| cttaccgctgttgagatccagttcgatgtaacccactcgtgcacccaactgatcttcagcatcttttactttcaccag |

TABLE 23-continued

| Sequence of pcDNA3-PhyciCas12b |
|---|
| cgtttctgggtgagcaaaaacaggaaggcaaaatgccgcaaaaaagggaataagggcgacacggaaatgttgaatact |
| catactcttcctttttcaatattattgaagcatttatcagggttattgtctcatgagcggatacatatttgaatgtat |
| ttagaaaaataaacaaataggggttccgcgcacatttccccgaaaagtgccacctgacgtc (SEQ ID NO: 584) |

Example 15

Figure 30:
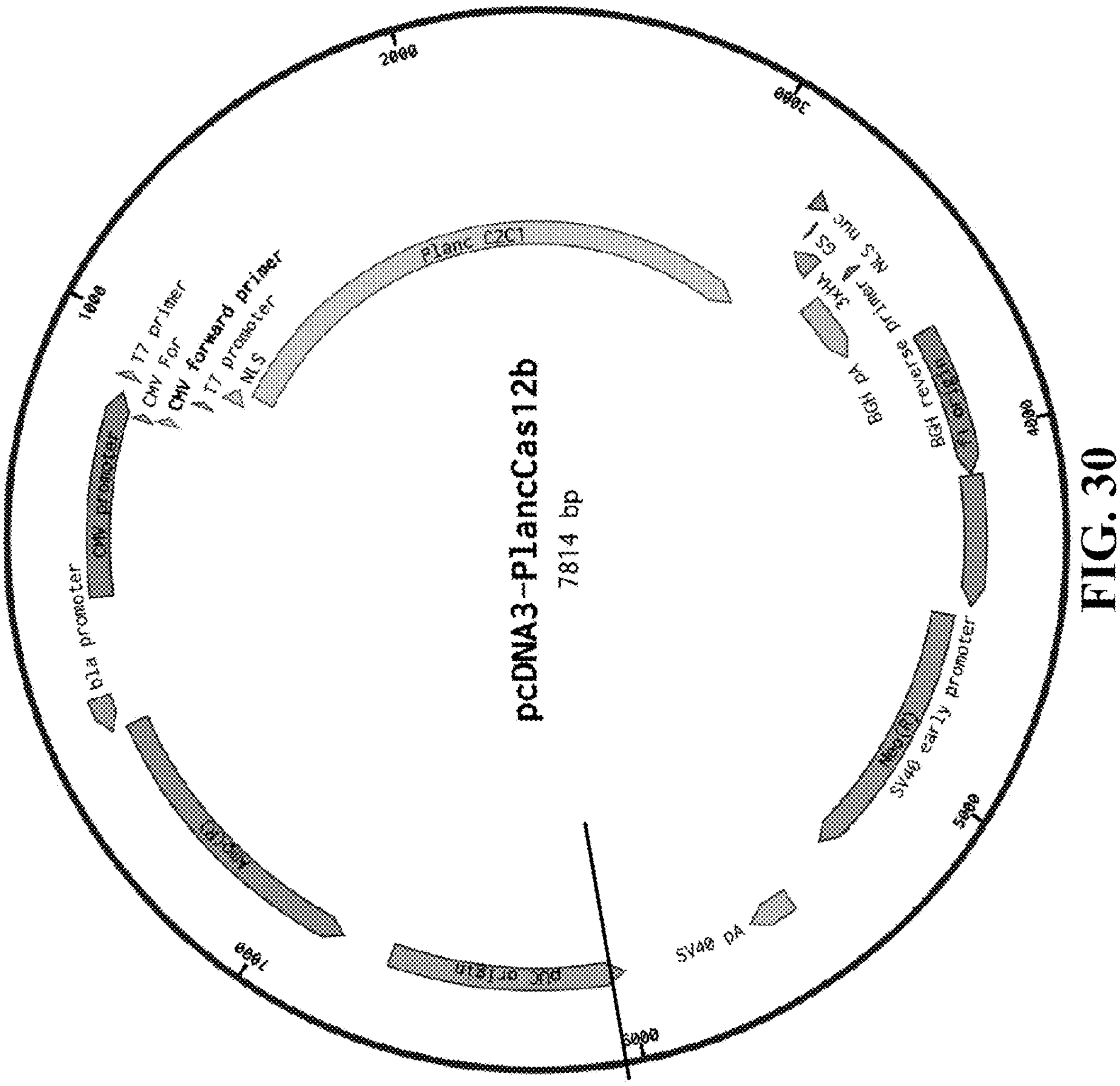
FIG. 30 shows a plasmid map of an exemplary construct containing PlancCas12b.

PlancCas12b (Planctomycetes bacterium Cas12b) was cloned into a plasmid (pcDNA3-PlancCas12b). A map of the plasmid is shown in FIG. 30. The sequence of the cloned construct is shown in Table 24 below.

TABLE 24

| Sequence of pcDNA3-PlancCas12b |
|---|
| gacggatcgggagatctcccgatcccctatggtgcactctcagtacaatctgctctgatgccgcatagttaagccagt |
| atctgctccctgcttgtgtgttggaggtcgctgagtagtgcgcgagcaaaatttaagctacaacaaggcaaggcttga |
| ccgacaattgcatgaagaatctgcttagggttaggcgttttgcgctgcttcgcgatgtacgggccagatatacgcgtt |
| gacattgattattgactagttattaatagtaatcaattacggggtcattagttcatagcccatatatggagttccgcg |
| ttacataacttacggtaaatggcccgcctggctgaccgcccaacgacccccgcccattgacgtcaataatgacgtatg |
| ttcccatagtaacgccaatagggactttccattgacgtcaatgggtggagtatttacggtaaactgcccacttggcag |
| tacatcaagtgtatcatatgccaagtacgccccctattgacgtcaatgacggtaaatggcccgcctggcattatgccc |
| agtacatgaccttatgggactttcctacttggcagtacatctacgtattagtcatcgctattaccatggtgatgcggt |
| tttggcagtacatcaatgggcgtggatagcggtttgactcacggggatttccaagtaccaccccattgacgtcaatgg |
| gagtttgttttggcaccaaaatcaacgggactttccaaaatgtcgtaacaactccgccccattgacgcaaatgggcgg |
| taggcgtgtacggtgggaggtctatataagcagagctctctggctaactagagaacccactgcttactggcttatcga |
| aattaatacgactcactatagggagacccaagctggctagcgtttaaacttaagcttgccacc |
| ATGGCCCCAAAGAAGAAGCGGAAGGTC |
| GGTATCCACGGAGTCCCAGCAGCCAGCGTGCGGAGCTTTCAGGCCAGAGTGGA |
| ATGCGACAAGCAGACCATGGAACACCTGTGGCGGACCCACAAGGTGTTCAAC |
| GAGAGACTGCCCGAGATCATCAAGATCCTGTTCAAGATGAAGCGGGGCGAGT |
| GCGGCCAGAACGATAAGCAGAAGTCCCTGTACAAGAGCATCAGCCAGAGCAT |
| CCTGGAAGCCAACGCTCAGAACGCCGACTACCTGCTGAACAGCGTGTCCATCA |
| AAGGCTGGAAGCCTGGCACCGCCAAGAAGTACAGAAACGCCAGCTTCACCTG |
| GGCCGACGATGCCGCTAAACTGTCTAGCCAGGGCATCCACGTGTACGACAAGA |
| AACAGGTGCTGGGCGACCTGCCTGGCATGATGTCTCAGATGGTCTGCAGGCAG |
| AGCGTGGAAGCCATCTCTGGACACATCGAGCTGACCAAGAAGTGGGAGAAAG |
| AACACAACGAGTGGCTGAAAGAAAAAGAGAAATGGGAGTCCGAGGACGAGC |
| ACAAGAAGTATCTGGACCTGCGCGAGAAGTTCGAGCAGTTTGAGCAGAGCATC |
| GGCGGCAAGATCACCAAGAGAAGAGGCCGGTGGCACCTGTACCTGAAGTGGC |
| TGAGCGACAACCCTGATTTTGCCGCCTGGCGGGGAAACAAGGCCGTGATCAAT |
| CCTCTGAGCGAGAAGGCCCAGATCAGGATCAACAAGGCCAAGCCGAACAAGA |
| AGAACAGCGTCGAGCGGGACGAGTTCTTCAAGGCCAATCCTGAGATGAAGGC |
| CCTGGACAACCTGCACGGCTACTACGAGCGGAATTTCGTGCGGCGGAGAAAGA |

TABLE 24-continued

| Sequence of pcDNA3-PlancCas12b |
| --- |
| CAAAGAAGAACCCCGACGGCTTCGACCACAAGCCTACCTTCACACTGCCCCAT |
| CCTACCATCCATCCTCGTTGGTTCGTGTTCAACAAGCCTAAGACAAACCCCGAG |
| GGCTACCGCAAGCTGATCCTGCCTAAAAAGGCCGGCGATCTGGGCAGCCTGGA |
| AATGAGACTGCTGACCGGCGAGAAGAACAAGGGCAACTACCCCGACGACTGG |
| ATCAGCGTGAAGTTTAAGGCCGATCCTCGGCTGAGCCTGATCAGACCCGTGAA |
| AGGCAGACGGGTTGTGCGGAAGGGCAAAGAGCAGGGCCAGACCAAAGAGAC |
| AGACAGCTACGAGTTTTTCGACAAGCACCTGAAGAAGTGGCGGCCTGCCAAAC |
| TGTCTGGCGTGAAGCTGATCTTCCCCGACAAGACACCTAAGGCCGCCTACCTG |
| TACTTCACCTGTGACATCCCCGACGAGCCCCTGACCGAGACAGCCAAGAAAAT |
| CCAGTGGCTGGAAACCGGCGACGTGACCAAAAAGGGCAAGAAACGCAAAAAG |
| AAGGTGCTGCCCCACGGCCTGGTGTCCTGTGCTGTTGATCTGAGCATGCGGAG |
| AGGCACCACCGGCTTTGCCACACTGTGCAGATACGAGAATGGCAAGATCCACA |
| TCCTGCGGAGCCGGAACCTGTGGGTCGGATACAAAGAAGGCAAGGGCTGTCA |
| CCCCTACAGATGGACAGAGGGACCCGACCTGGGACACATTGCCAAGCACAAG |
| AGAGAGATCAGAATCCTGCGGTCCAAGCGGGGCAAGCCTGTGAAGGGCGAAG |
| AGAGCCACATCGACCTGCAGAAACACATCGACTACATGGGCGAAGATCGGTTC |
| AAGAAGGCCGCCAGAACCATCGTGAACTTCGCCCTGAACACCGAGAACGCCG |
| CCAGCAAGAATGGCTTCTACCCCAGAGCTGACGTGCTGCTGCTGGAAAACCTG |
| GAAGGACTGATCCCCGATGCCGAGAAAGAGCGGGGCATCAATAGAGCCCTGG |
| CCGGCTGGAATAGACGGCACCTGGTTGAGCGCGTGATCGAGATGGCCAAGGAT |
| GCCGGCTTCAAGCGGCGGGTGTTCGAGATCCCACCTTACGGCACAAGCCAAGT |
| GTGCAGCAAATGTGGCGCCCTGGGCAGAAGATACAGCATCATCAGAGAGAAC |
| AACCGGCGCGAGATCAGATTCGGCTACGTGGAAAAGCTGTTCGCCTGTCCTAA |
| CTGCGGCTACTGCGCCAACGCCGATCACAATGCCAGCGTGAACCTGAACCGGC |
| GGTTCCTGATCGAGGACAGCTTCAAGTCCTACTACGACTGGAAGCGGCTGTCC |
| GAGAAGAAGCAGAAAGAGGAAATCGAGACAATCGAGTCCAAGCTGATGGATA |
| AGCTGTGCGCCATGCACAAGATCAGCCGGGGCAGCATCAGCAAGAAAAGGCC |
| GGCGGCCACGAAAAAGGCCGGCCAGGCAAAAAAGAAAAAGGGATCCTACCCA |
| TACGATGTTCCAGATTACGCTTATCCCTACGACGTGCCTGATTATGCATACCCA |
| TATGATGTCCCCGACTATGCCTAAGaattctgcagatatccagcacagtggcggccgctcgagtctagagg |
| gcccgtttaaacccgctgatcagcctcgactgtgccttctagttgccagccatctgttgtttgcccctcccccgtgcc |
| ttccttgaccctggaaggtgccactcccactgtcctttcctaataaaatgaggaaattgcatcgcattgtctgagtag |
| gtgtcattctattctggggggtggggtggggcaggacagcaagggggaggattgggaagacaatagcaggcatgctgg |
| ggatgcggtgggctctatggcttctgaggcggaaagaaccagaggggctctagggggtatccccacgcgccagtagcg |
| gcgcattaagcgcggcgggtgtggtggttacgcgcagcgtgaccgctacacttgccagcgccctagcgcccgctcctt |
| tcgctttcttcccttcctttctcgccacgttcgccggctttccccgtcaagctctaaatcgggggctccctttagggt |
| tccgatttagtgctttacggcacctcgaccccaaaaaacttgattagggtgatggttcacgtagtgggccatcgccct |
| gatagacggtttttcgccctttgttcgttggagtccacgttctttaatagtggactcttgttccaaactggaacaaca |
| ctcaaccctatctcggtctattcttttgatttataagggattttgccgatttcggcctattggttaaaaaatgagctg |

TABLE 24-continued

| Sequence of pcDNA3-PlancCas12b |
| --- |
| atttaacaaaatttaacgcgaattaattctgtggaatgtgtgtcagttagggtgtggaaagtccccaggctccccag |
| caggcagaagtatgcaaagcatgcatctcaattagtcagcaaccaggtgtggaaagtccccaggctccccagcaggca |
| gaagtatgcaaagcatgcatctcaattagtcagcaaccatagtcccgcccctaactccgcccatcccgcccctaactc |
| cgcccagttccgcccattctccgccccatggctgactaattttttttatttatgcagaggccgaggccgcctctgcct |
| ctgagctattccagaagtagtgaggaggcttttttggaggcctaggcttttgcaaaaagctcccgggagcttgtatat |
| ccattttcggatctgatcaagagacaggatgaggatcgtttcgcatgattgaacaagatggattgcacgcaggttctc |
| cggccgcttgggtggagaggctattcggctatgactgggcacaacagacaatcggctgctctgatgccgccgtgttcc |
| ggctgtcagcgcaggggcgcccggttctttttgtcaagaccgacctgtccggtgccctgaatgaactgcaggacgag |
| gcagcgcggctatcgtggctggccacgacgggcgttccttgcgcagctgtgctcgacgttgtcactgaagcgggaagg |
| gactggctgctattgggcgaagtgccggggcaggatctcctgtcatctcaccttgctcctgccgagaaagtatccatc |
| atggctgatgcaatgcggcggctgcatacgcttgatccggctacctgcccattcgaccaccaagcgaaacatcgcatc |
| gagcgagcacgtactcggatggaagccggtcttgtcgatcaggatgatctggacgaagagcatcaggggctcgcgcca |
| gccgaactgttcgccaggctcaaggcgcgcatgcccgacggcgaggatctcgtcgtgacccatggcgatgcctgcttg |
| ccgaatatcatggtggaaaatggccgcttttctggattcatcgactgtggccggctgggtgtggcggaccgctatcag |
| gacatagcgttggctacccgtgatattgctgaagagcttggcggcgaatgggctgaccgcttcctcgtgctttacggt |
| atcgccgctcccgattcgcagcgcatcgccttctatcgccttcttgacgagttcttctgagcgggactctggggttcg |
| aaatgaccgaccaagcgacgcccaacctgccatcacgagatttcgattccaccgccgccttctatgaaaggttgggct |
| tcggaatcgttttccgggacgccggctggatgatcctccagcgcggggatctcatgctggagttcttcgcccacccca |
| acttgtttattgcagcttataatggttacaaataaagcaatagcatcacaaatttcacaaataaagcatttttttcac |
| tgcattctagttgtggtttgtccaaactcatcaatgtatcttatcatgtctgtataccgtcgacctctagctagagct |
| tggcgtaatcatggtcatagctgtttcctgtgtgaaattgttatccgctcacaattccacacaacatacgagccggaa |
| gcataaagtgtaaagcctggggtgcctaatgagtgagctaactcacattaattgcgttgcgctcactgcccgctttcc |
| agtcgggaaacctgtcgtgccagctgcattaatgaatcggccaacgcgcggggagaggcggtttgcgtattgggcgct |
| cttccgcttcctcgctcactgactcgctgcgctcggtcgttcggctgcggcgagcggtatcagctcactcaaaggcgg |
| taatacggttatccacagaatcaggggataacgcaggaaagaacatgtgagcaaaaggccagcaaaaggccaggaacc |
| gtaaaaaggccgcgttgctggcgtttttccataggctccgcccccctgacgagcatcacaaaaatcgacgctcaagtc |
| agaggtggcgaaacccgacaggactataaagataccaggcgtttccccctggaagctccctcgtgcgctctcctgttc |
| cgaccctgccgcttaccggatacctgtccgcctttctcccttcgggaagcgtggcgctttctcatagctcacgctgta |
| ggtatctcagttcggtgtaggtcgttcgctccaagctgggctgtgtgcacgaaccccccgttcagcccgaccgctgcg |
| ccttatccggtaactatcgtcttgagtccaacccggtaagacacgacttatcgccactggcagcagccactggtaaca |
| ggattagcagagcgaggtatgtaggcggtgctacagagttcttgaagtggtggcctaactacggctacactagaagaa |
| cagtatttggtatctgcgctctgctgaagccagttaccttcggaaaaagagttggtagctcttgatccggcaaacaaa |
| ccaccgctggtagcggtttttttgtttgcaagcagcagattacgcgcagaaaaaaaggatctcaagaagatcctttga |
| tcttttctacggggtctgacgctcagtggaacgaaaactcacgttaagggattttggtcatgagattatcaaaaagga |
| tcttcacctagatccttttaaattaaaaatgaagttttaaatcaatctaaagtatatatgagtaaacttggtctgaca |
| gttaccaatgcttaatcagtgaggcacctatctcagcgatctgtctatttcgttcatccatagttgcctgactccccg |
| tcgtgtagataactacgatacgggagggcttaccatctggccccagtgctgcaatgataccgcgagacccacgctcac |
| cggctccagatttatcagcaataaaccagccagccggaagggccgagcgcagaagtggtcctgcaactttatccgcct |
| ccatccagtctattaattgttgccgggaagctagagtaagtagttcgccagttaatagtttgcgcaacgttgttgcca |

TABLE 24-continued

| Sequence of pcDNA3-PlancCas12b |
|---|
| ttgctacaggcatcgtggtgtcacgctcgtcgtttggtatggcttcattcagctccggttcccaacgatcaaggcgag |
| ttacatgatcccccatgttgtgcaaaaaagcggttagctccttcggtcctccgatcgttgtcagaagtaagttggccg |
| cagtgttatcactcatggttatggcagcactgcataattctcttactgtcatgccatccgtaagatgcttttctgtga |
| ctggtgagtactcaaccaagtcattctgagaatagtgtatgcggcgaccgagttgctcttgcccggcgtcaatacggg |
| ataataccgcgccacatagcagaactttaaaagtgctcatcattggaaaacgttcttcggggcgaaaactctcaagga |
| tcttaccgctgttgagatccagttcgatgtaacccactcgtgcacccaactgatcttcagcatcttttactttcacca |
| gcgtttctgggtgagcaaaaacaggaaggcaaaatgccgcaaaaaagggaataagggcgacacggaaatgttgaatac |
| tcatactcttcctttttcaatattattgaagcatttatcagggttattgtctcatgagcggatacatatttgaatgta |
| tttagaaaaataaacaaataggggttccgcgcacatttccccgaaaagtgccacctgacgtc (SEQ ID NO: 585) |

Example 16

Figure 31:
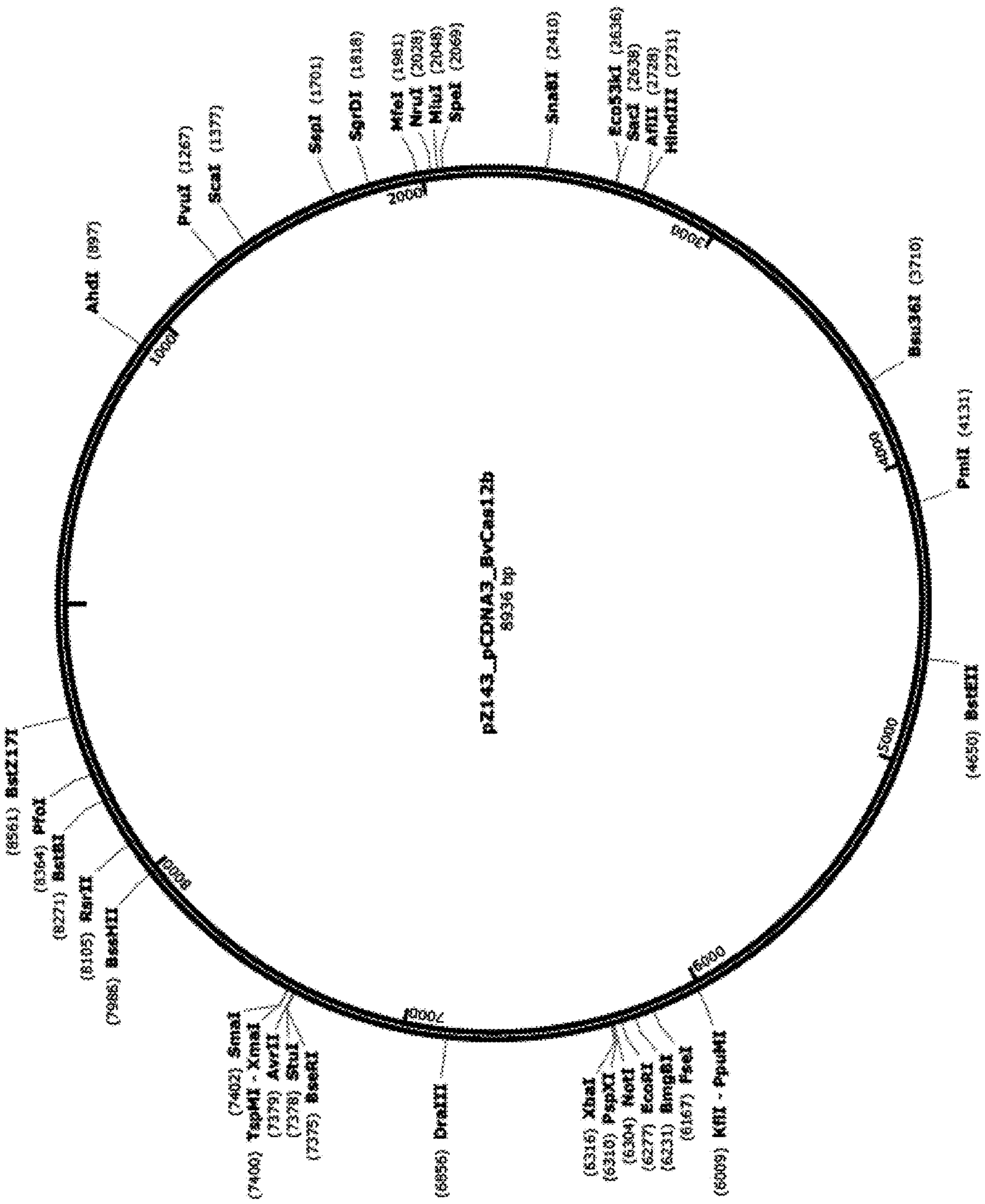
FIG. 31 shows a plasmid map of an exemplary construct pZ143-pcDNA3-BvCas12b containing BvCas12b.

Plasmid pZ143-pcDNA3-BvCas12b containing BvCas12b was generated. A map of the plasmid is shown in FIG. 31 and the sequence of the cloned construct is shown in Table 25 below.

TABLE 25

| Sequence of pZ143-pcDNA3-BvCas12b |
|---|
| AGAACATGTGAGCAAAAGGCCAGCAAAAGGCCAGGAACCGTAAAAAGGCCGCGTTGCTGGCGTTTTTCCATAGGCTCC |
| GCCCCCCTGACGAGCATCACAAAAATCGACGCTCAAGTCAGAGGTGGCGAAACCCGACAGGACTATAAAGATACCAGG |
| CGTTTCCCCCTGGAAGCTCCCTCGTGCGCTCTCCTGTTCCGACCCTGCCGCTTACCGGATACCTGTCCGCCTTTCTCC |
| CTTCGGGAAGCGTGGCGCTTTCTCATAGCTCACGCTGTAGGTATCTCAGTTCGGTGTAGGTCGTTCGCTCCAAGCTGG |
| GCTGTGTGCACGAACCCCCCGTTCAGCCCGACCGCTGCGCCTTATCCGGTAACTATCGTCTTGAGTCCAACCCGGTAA |
| GACACGACTTATCGCCACTGGCAGCAGCCACTGGTAACAGGATTAGCAGAGCGAGGTATGTAGGCGGTGCTACAGAGT |
| TCTTGAAGTGGTGGCCTAACTACGGCTACACTAGAAGAACAGTATTTGGTATCTGCGCTCTGCTGAAGCCAGTTACCT |
| TCGGAAAAAGAGTTGGTAGCTCTTGATCCGGCAAACAAACCACCGCTGGTAGCGGTGGTTTTTTTGTTTGCAAGCAGC |
| AGATTACGCGCAGAAAAAAAGGATCTCAAGAAGATCCTTTGATCTTTTCTACGGGGTCTGACGCTCAGTGGAACGAAA |
| ACTCACGTTAAGGGATTTTGGTCATGAGATTATCAAAAAGGATCTTCACCTAGATCCTTTTAAATTAAAAATGAAGTT |
| TTAAATCAATCTAAAGTATATATGAGTAAACTTGGTCTGACAGTTACCAATGCTTAATCAGTGAGGCACCTATCTCAG |
| CGATCTGTCTATTTCGTTCATCCATAGTTGCCTGACTCCCCGTCGTGTAGATAACTACGATACGGGAGGGCTTACCAT |
| CTGGCCCCAGTGCTGCAATGATACCGCGAGACCCACGCTCACCGGCTCCAGATTTATCAGCAATAAACCAGCCAGCCG |
| GAAGGGCCGAGCGCAGAAGTGGTCCTGCAACTTTATCCGCCTCCATCCAGTCTATTAATTGTTGCCGGGAAGCTAGAG |
| TAAGTAGTTCGCCAGTTAATAGTTTGCGCAACGTTGTTGCCATTGCTACAGGCATCGTGGTGTCACGCTCGTCGTTTG |
| GTATGGCTTCATTCAGCTCCGGTTCCCAACGATCAAGGCGAGTTACATGATCCCCCATGTTGTGCAAAAAAGCGGTTA |
| GCTCCTTCGGTCCTCCGATCGTTGTCAGAAGTAAGTTGGCCGCAGTGTTATCACTCATGGTTATGGCAGCACTGCATA |
| ATTCTCTTACTGTCATGCCATCCGTAAGATGCTTTTCTGTGACTGGTGAGTACTCAACCAAGTCATTCTGAGAATAGT |
| GTATGCGGCGACCGAGTTGCTCTTGCCCGGCGTCAATACGGGATAATACCGCGCCACATAGCAGAACTTTAAAAGTGC |
| TCATCATTGGAAAACGTTCTTCGGGGCGAAAACTCTCAAGGATCTTACCGCTGTTGAGATCCAGTTCGATGTAACCCA |
| CTCGTGCACCCAACTGATCTTCAGCATCTTTTACTTTCACCAGCGTTTCTGGGTGAGCAAAAACAGGAAGGCAAAATG |
| CCGCAAAAAAGGGAATAAGGGCGACACGGAAATGTTGAATACTCATACTCTTCCTTTTTCAATATTATTGAAGCATTT |
| ATCAGGGTTATTGTCTCATGAGCGGATACATATTTGAATGTATTTAGAAAAATAAACAAATAGGGGTTCCGCGCACAT |

TABLE 25-continued

| Sequence of pZ143-pcDNA3-BvCas12b |
| --- |
| TTCCCCGAAAAGTGCCACCTGACGTCGACGGATCGGGAGATCTCCCGATCCCCTATGGTGCACTCTCAGTACAATCTG |
| CTCTGATGCCGCATAGTTAAGCCAGTATCTGCTCCCTGCTTGTGTGTTGGAGGTCGCTGAGTAGTGCGCGAGCAAAAT |
| TTAAGCTACAACAAGGCAAGGCTTGACCGACAATTGCATGAAGAATCTGCTTAGGGTTAGGCGTTTTGCGCTGCTTCG |
| CGATGTACGGGCCAGATATACGCGTTGACATTGATTATTGACTAGTTATTAATAGTAATCAATTACGGGGTCATTAGT |
| TCATAGCCCATATATGGAGTTCCGCGTTACATAACTTACGGTAAATGGCCCGCCTGGCTGACCGCCCAACGACCCCCG |
| CCCATTGACGTCAATAATGACGTATGTTCCCATAGTAACGCCAATAGGGACTTTCCATTGACGTCAATGGGTGGAGTA |
| TTTACGGTAAACTGCCCACTTGGCAGTACATCAAGTGTATCATATGCCAAGTACGCCCCCTATTGACGTCAATGACGG |
| TAAATGGCCCGCCTGGCATTATGCCCAGTACATGACCTTATGGGACTTTCCTACTTGGCAGTACATCTACGTATTAGT |
| CATCGCTATTACCATGGTGATGCGGTTTTGGCAGTACATCAATGGGCGTGGATAGCGGTTTGACTCACGGGGATTTCC |
| AAGTCTCCACCCCATTGACGTCAATGGGAGTTTGTTTTGGCACCAAAATCAACGGGACTTTCCAAAATGTCGTAACAA |
| CTCCGCCCCATTGACGCAAATGGGCGGTAGGCGTGTACGGTGGGAGGTCTATATAAGCAGAGCTCTCTGGCTAACTAG |
| AGAACCCACTGCTTACTGGCTTATCGAAATTAATACGACTCACTATAGGGAGACCCAAGCTGGCTAGCGTTTAAACTT |
| AAGCTTGCCACCATGGCCCCAAAGAAGAAGCGGAAGGTCGGTATCCACGGAGTCCCAGCAGCCGGATCCGCCATCCGG |
| TCCATCAAGCTGAAGATGAAGACCAACAGCGGCACCGACAGCATCTACCTGAGAAAAGCCCTGTGGCGGACCCACCAG |
| CTGATCAATGAGGGAATCGCCTACTACATGAACCTGCTGACCCTGTACCGGCAAGAGGCCATCGGCGACAAGACCAAA |
| GAAGCCTATCAGGCCGAGCTGATTAACATCATCCGGAACCAGCAGCGGAACAACGGCAGCTCTGAGGAACACGGCTCC |
| GACCAAGAAATTCTGGCCCTGCTGAGACAGCTGTACGAGCTGATCATCCCCAGCAGCATCGGCGAATCTGGCGACGCT |
| AATCAGCTGGGCAACAAGTTTCTGTACCCTCTGGTGGACCCCAACAGCCAGTCTGGCAAGGGCACATCTAACGCCGGC |
| AGAAAGCCCAGATGGAAGCGGCTGAAAGAGGAAGGCAACCCCGACTGGGAACTCGAGAAGAAGAAGGACGAGGAACGC |
| AAGGCCAAGGATCCCACCGTGAAGATCTTTGACAACCTGAACAAATACGGCCTGCTGCCTCTGTTCCCACTGTTCACC |
| AACATCCAGAAAGACATCGAGTGGCTGCCCCTGGGCAAGAGACAGTCTGTGCGGAAGTGGGACAAAGACATGTTCATC |
| CAGGCCATCGAGAGACTGCTGAGCTGGGAGAGCTGGAACAGAAGAGTGGCCGACGAGTACAAACAGCTGAAAGAAAAG |
| ACCGAGAGCTACTACAAAGAGCACCTGACAGGCGGCGAGGAATGGATCGAGAAGATCCGGAAGTTCGAGAAAGAACGG |
| AACATGGAACTGGAAAAGAACGCCTTCGCTCCCAACGACGGCTACTTCATCACCAGCAGACAGATCAGAGGCTGGGAC |
| AGAGTGTACGAGAAGTGGTCCAAGCTGCCCGAGTCTGCTAGCCCTGAGGAACTGTGGAAAGTGGTGGCCGAGCAGCAG |
| AACAAGATGTCCGAAGGCTTCGGCGACCCCAAGGTGTTCAGCTTCCTGGCCAACAGAGAGAACCGGGACATTTGGAGA |
| GGCCACAGCGAGCGGATCTACCACATTGCCGCCTACAACGGCCTGCAGAAGAAGCTGAGCCGGACCAAAGAGCAGGCC |
| ACCTTCACACTGCCTGACGCCATTGAACACCCTCTGTGGATCAGATACGAGAGCCCTGGCGGCACCAACCTGAATCTG |
| TTCAAGCTGGAAGAGAAACAGAAAAAGAACTACTACGTGACCCTGAGCAAGATCATCTGGCCCAGCGAGGAAAAGTGG |
| ATTGAGAAAGAGAACATCGAGATCCCTCTGGCTCCCAGCATCCAGTTCAACCGGCAGATTAAGCTGAAGCAGCACGTG |
| AAGGGCAAGCAAGAGATCAGCTTCAGCGACTACAGCAGCCGGATCAGCCTGGATGGTGTTCTCGGCGGCAGCAGAATC |
| CAGTTTAATCGGAAGTACATCAAGAACCACAAAGAGCTGCTCGGAGAGGGCGACATCGGCCCCGTGTTCTTTAACCTG |
| GTGGTGGATGTGGCCCCTCTGCAAGAAACCAGAAACGGCAGACTGCAGAGCCCCATCGGCAAGGCCCTGAAAGTGATC |
| AGCAGCGACTTCTCCAAAGTGATCGACTACAAGCCGAAAGAACTCATGGATTGGATGAATACCGGCAGCGCCAGCAAC |
| AGCTTTGGAGTGGCTTCTCTGCTGGAAGGCATGAGAGTGATGAGCATCGACATGGGCCAGAGAACCAGCGCCTCCGTG |
| TCCATCTTCGAGGTCGTGAAAGAACTGCCCAAGGATCAAGAGCAGAAAGCTGTTCTACAGCATCAACGACACCGAGCTG |
| TTCGCCATCCACAAGCGGAGCTTTCTGCTGAACCTGCCTGGCGAGGTGGTCACCAAGAACAACAAGCAGCAGCGGCAA |
| GAGCGGCGGAAAAAGCGGCAGTTTGTGCGGAGCCAGATCAGAATGCTGGCCAACGTGCTGCGGCTGGAAACAAAGAAA |
| ACCCCTGACGAGCGGAAGAAGGCCATTCACAAGCTGATGGAAATCGTGCAGAGCTACGACAGCTGGACCGCCAGCCAG |

TABLE 25-continued

| Sequence of pZ143-pcDNA3-BvCas12b |
| --- |
| AAAGAAGTGTGGGAGAAAGAGCTGAATCTCCTGACCAACATGGCCGCCTTCAATGACGAGATCTGGAAAGAAAGCCTG |
| GTGGAACTGCACCACCGGATCGAGCCTTACGTGGGACAGATCGTGTCCAAGTGGCGGAAGGGCCTGTCTGAGGGCAGA |
| AAGAATCTGGCCGGCATCAGCATGTGGAACATCGACGAACTGGAAGATACCAGGCGGCTGCTGATTTCCTGGTCCAAG |
| AGAAGCAGAACCCCAGGCGAGGCCAACAGGATCGAAACCGATGAGCCTTTCGGCAGCAGCCTGCTCCAGCACATTCAG |
| AACGTGAAGGACGACAGACTGAAGCAGATGGCCAACCTGATCATCATGACAGCCCTGGGCTTTAAGTACGACAAAGAG |
| GAAAAGGACCGGTACAAGCGGTGGAAAGAGACATACCCCGCCTGCCAGATCATCCTGTTCGAGAACCTGAACCGCTAC |
| CTGTTCAACCTCGACCGGTCCAGACGCGAGAACAGCAGACTGATGAAGTGGGCCCATCGGAGCATCCCCAGAACCGTG |
| TCTATGCAGGGCGAGATGTTCGGCCTGCAAGTGGGCGACGTTCGGAGCGAGTACAGCTCCAGATTCCACGCCAAAACA |
| GGCGCCCCTGGCATCAGATGTCACGCCCTGACTGAAGAGGATCTGAAGGCCGGCAGCAACACCCTGAAGAGACTGATC |
| GAGGACGGCTTCATCAATGAGAGCGAGCTGGCCTACCTGAAGAAGGGCGATATCATCCCTAGCCAAGGCGGCGAACTG |
| TTCGTGACACTGTCCAAGCGGTACAAGAAGGACAGCGACAACAACGAGCTGACCGTGATCCACGCCGACATCAACGCC |
| GCTCAGAATCTGCAGAAGCGGTTTTGGCAGCAAAACAGCGAGGTGTACAGAGTGCCCTGTCAGCTGGCCAGAATGGGC |
| GAAGATAAGCTGTACATCCCCAAGAGCCAGACCGAGACAATCAAGAAGTATTTCGGCAAGGGCTCCTTCGTGAAGAAC |
| AATACCGAACAAGAGGTCTACAAGTGGGAGAAGTCCGAGAAAATGAAGATCAAGACGGACACCACCTTCGACCTGCAA |
| GACCTGGATGGCTTCGAGGACATCAGCAAGACCATTGAGCTGGCACAAGAGCAGCAAAAGAAATACCTGACCATGTTC |
| AGGGACCCCAGCGGCTACTTTTTCAACAATGAGACATGGCGGCCTCAAAAAGAATACTGGTCCATCGTGAACAACATC |
| ATCAAGAGCTGCCTCAAGAAGAAGATCCTGAGCAACAAGGTCGAGCTGGGATCCAAAAGGCCGGCGGCCACGAAAAAG |
| GCCGGCCAGGCAAAAAAGAAAAAGggatctTACCCATACGATGTTCCAGATTACGCTTATCCCTACGACGTGCCTGAT |
| TATGCATACCCATATGATGTCCCCGACTATGCCtaaGAATTCTGCAGATATCCAGCACAGTGGCGGCCGCTCGAGTCT |
| AGAGGGCCCGTTTAAACCCGCTGATCAGCCTCGACTGTGCCTTCTAGTTGCCAGCCATCTGTTGTTTGCCCCTCCCCC |
| GTGCCTTCCTTGACCCTGGAAGGTGCCACTCCCACTGTCCTTTCCTAATAAAATGAGGAAATTGCATCGCATTGTCTG |
| AGTAGGTGTCATTCTATTCTGGGGGGTGGGGTGGGGCAGGACAGCAAGGGGGAGGATTGGGAAGACAATAGCAGGCAT |
| GCTGGGGATGCGGTGGGCTCTATGGCTTCTGAGGCGGAAAGAACCAGCTGGGGCTCTAGGGGGTATCCCCACGCGCCC |
| TGTAGCGGCGCATTAAGCGCGGCGGGTGTGGTGGTTACGCGCAGCGTGACCGCTACACTTGCCAGCGCCCTAGCGCCC |
| GCTCCTTTCGCTTTCTTCCCTTCCTTTCTCGCCACGTTCGCCGGCTTTCCCCGTCAAGCTCTAAATCGGGGGCTCCCT |
| TTAGGGTTCCGATTTAGTGCTTTACGGCACCTCGACCCCAAAAAACTTGATTAGGGTGATGGTTCACGTAGTGGGCCA |
| TCGCCCTGATAGACGGTTTTTCGCCCTTTGACGTTGGAGTCCACGTTCTTTAATAGTGGACTCTTGTTCCAAACTGGA |
| ACAACACTCAACCCTATCTCGGTCTATTCTTTTGATTTATAAGGGATTTTGCCGATTTCGGCCTATTGGTTAAAAAAT |
| GAGCTGATTTAACAAAAATTTAACGCGAATTAATTCTGTGGAATGTGTGTCAGTTAGGGTGTGGAAAGTCCCCAGGCT |
| CCCCAGCAGGCAGAAGTATGCAAAGCATGCATCTCAATTAGTCAGCAACCAGGTGTGGAAAGTCCCCAGGCTCCCCAG |
| CAGGCAGAAGTATGCAAAGCATGCATCTCAATTAGTCAGCAACCATAGTCCCGCCCCTAACTCCGCCCATCCCGCCCC |
| TAACTCCGCCCAGTTCCGCCCATTCTCCGCCCCATGGCTGACTAATTTTTTTTATTTATGCAGAGGCCGAGGCCGCCT |
| CTGCCTCTGAGCTATTCCAGAAGTAGTGAGGAGGCTTTTTTGGAGGCCTAGGCTTTTGCAAAAAGCTCCCGGGAGCTT |
| GTATATCCATTTTCGGATCTGATCAAGAGACAGGATGAGGATCGTTTCGCATGATTGAACAAGATGGATTGCACGCAG |
| GTTCTCCGGCCGCTTGGGTGGAGAGGCTATTCGGCTATGACTGGGCACAACAGACAATCGGCTGCTCTGATGCCGCCG |
| TGTTCCGGCTGTCAGCGCAGGGGCGCCCGGTTCTTTTTGTCAAGACCGACCTGTCCGGTGCCCTGAATGAACTGCAGG |
| ACGAGGCAGCGCGGCTATCGTGGCTGGCCACGACGGGCGTTCCTTGCGCAGCTGTGCTCGACGTTGTCACTGAAGCGG |
| GAAGGGACTGGCTGCTATTGGGCGAAGTGCCGGGGCAGGATCTCCTGTCATCTCACCTTGCTCCTGCCGAGAAAGTAT |
| CCATCATGGCTGATGCAATGCGGCGGCTGCATACGCTTGATCCGGCTACCTGCCCATTCGACCACCAAGCGAAACATC |

TABLE 25-continued

| Sequence of pZ143-pcDNA3-BvCas12b |
|---|
| GCATCGAGCGAGCACGTACTCGGATGGAAGCCGGTCTTGTCGATCAGGATGATCTGGACGAAGAGCATCAGGGGCTCG |
| CGCCAGCCGAACTGTTCGCCAGGCTCAAGGCGCGCATGCCCGACGGCGAGGATCTCGTCGTGACCCATGGCGATGCCT |
| GCTTGCCGAATATCATGGTGGAAAATGGCCGCTTTTCTGGATTCATCGACTGTGGCCGGCTGGGTGTGGCGGACCGCT |
| ATCAGGACATAGCGTTGGCTACCCGTGATATTGCTGAAGAGCTTGGCGGCGAATGGGCTGACCGCTTCCTCGTGCTTT |
| ACGGTATCGCCGCTCCCGATTCGCAGCGCATCGCCTTCTATCGCCTTCTTGACGAGTTCTTCTGAGCGGGACTCTGGG |
| GTTCGAAATGACCGACCAAGCGACGCCCAACCTGCCATCACGAGATTTCGATTCCACCGCCGCCTTCTATGAAAGGTT |
| GGGCTTCGGAATCGTTTTCCGGGACGCCGGCTGGATGATCCTCCAGCGCGGGGATCTCATGCTGGAGTTCTTCGCCCA |
| CCCCAACTTGTTTATTGCAGCTTATAATGGTTACAAATAAAGCAATAGCATCACAAATTTCACAAATAAAGCATTTTT |
| TTCACTGCATTCTAGTTGTGGTTTGTCCAAACTCATCAATGTATCTTATCATGTCTGTATACCGTCGACCTCTAGCTA |
| GAGCTTGGCGTAATCATGGTCATAGCTGTTTCCTGTGTGAAATTGTTATCCGCTCACAATTCCACACAACATACGAGC |
| CGGAAGCATAAAGTGTAAAGCCTGGGGTGCCTAATGAGTGAGCTAACTCACATTAATTGCGTTGCGCTCACTGCCCGC |
| TTTCCAGTCGGGAAACCTGTCGTGCCAGCTGCATTAATGAATCGGCCAACGCGCGGGGAGAGGCGGTTTGCGTATTGG |
| GCGCTCTTCCGCTTCCTCGCTCACTGACTCGCTGCGCTCGGTCGTTCGGCTGCGGCGAGCGGTATCAGCTCACTCAAA |
| GGCGGTAATACGGTTATCCACAGAATCAGGGGATAACGCAGGAA (SEQ ID NO: 586) |

Figure 32:
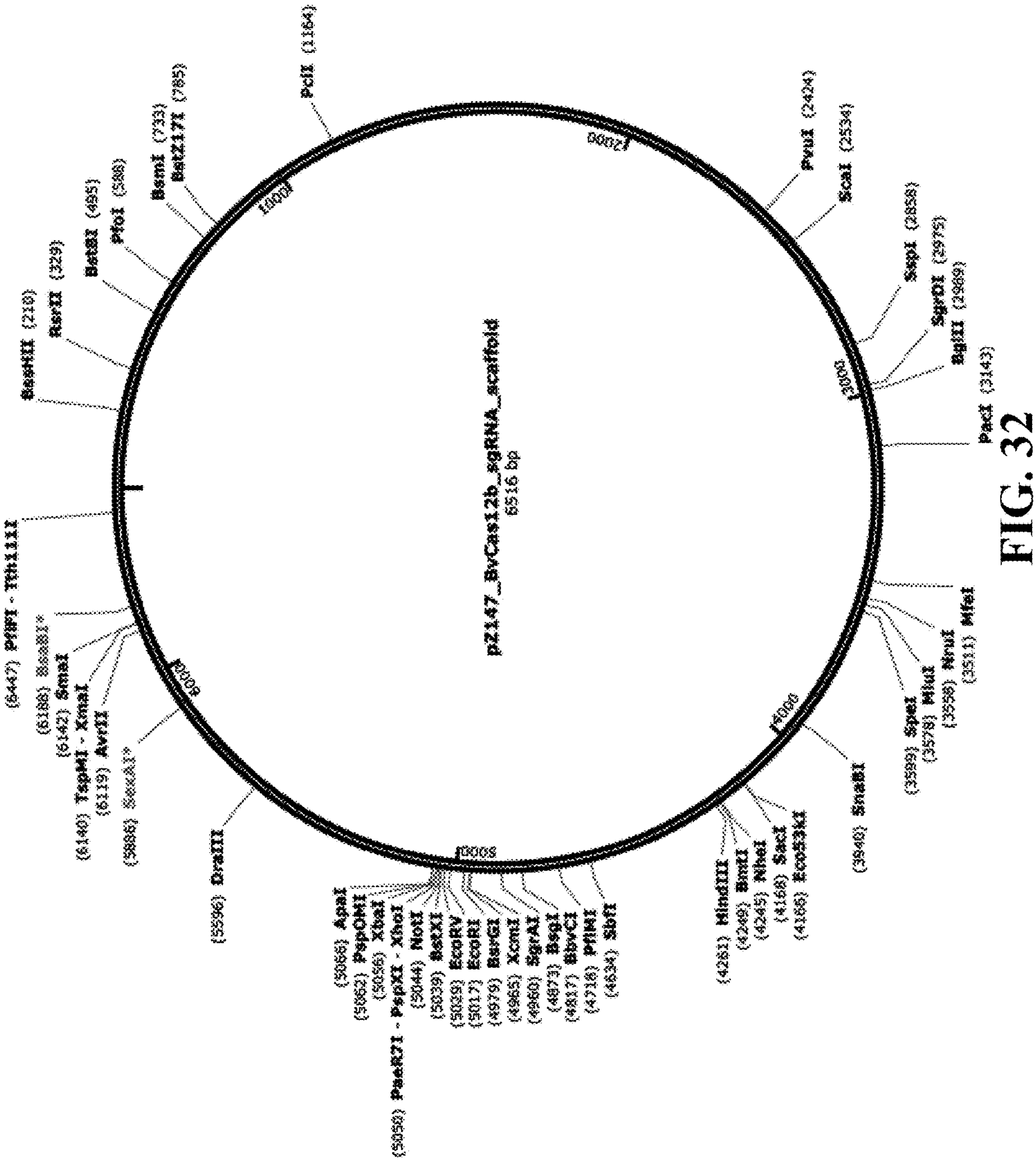
FIG. 32 shows a plasmid map of an exemplary construct pZ147-BvCas12b-sgRNA-scaffold containing BvCas12b sgRNA scaffold.

Plasmid pZ147-BvCas12b-sgRNA-scaffold containing BvCas12b sgRNA scaffold was generated. A map of the plasmid is shown in FIG. 32 and the sequence of the cloned construct is shown in Table 26 below.

TABLE 26

| Sequence of pZ147-BvCas12b-sgRNA-scaffold |
|---|
| accttgacctgccgagaaagtatccatcatggctgatgcaatgcggcggc |
| tgcatacgcttgatccggctacctgcccattcgaccaccaagcgaaacat |
| cgcatcgagcgagcacgtactcggatggaagccggtatgtcgatcaggat |
| gatctggacgaagagcatcaggggctcgcgccagccgaactgttcgccag |
| gctcaaggcgcgcatgcccgacggcgaggatctcgtcgtgacccatggcg |
| atgcctgatgccgaatatcatggtggaaaatggccgatttctggattcat |
| cgactgtggccggctgggtgtggcggaccgctatcaggacatagcgttgg |
| ctacccgtgatattgctgaagagcttggcggcgaatgggctgaccgcttc |
| ctcgtgattacggtatcgccgctcccgattcgcagcgcatcgcatctatc |
| gccttatgacgagttatctgagcgggactaggggttcgaaatgaccgacc |
| aagcgacgcccaacctgccatcacgagatttcgattccaccgccgcatct |
| atgaaaggttgggatcggaatcgttttccgggacgccggctggatgatcc |
| tccagcgcggggatacatgctggagttcttcgcccaccccaacttgttta |
| ttgcagatataatggttacaaataaagcaatagcatcacaaatttcacaa |
| ataaagcatttttttcactgcattctagttgtggtttgtccaaactcatc |
| aatgtatcttatcatgtagtataccgtcgacactagctagagcttggcgt |
| aatcatggtcatagagtttcctgtgtgaaattgttatccgctcacaattc |
| cacacaacatacgagccggaagcataaagtgtaaagcctggggtgcctaa |

TABLE 26-continued

| Sequence of pZ147-BvCas12b-sgRNA-scaffold |
|---|
| tgagtgagctaactcacattaattgcgttgcgctcactgcccgattccag |
| tcgggaaacctgtcgtgccagagcattaatgaatcggccaacgcgcgggg |
| agaggcggtttgcgtattgggcgctatccgatcctcgctcactgactcgc |
| tgcgctcggtcgttcggctgcggcgagcggtatcagctcactcaaaggcg |
| gtaatacggttatccacagaatcaggggataacgcaggaaagaacatgtg |
| agcaaaaggccagcaaaaggccaggaaccgtaaaaaggccgcgttgctgg |
| cgtttttccataggctccgcccccctgacgagcatcacaaaaatcgacgc |
| tcaagtcagaggtggcgaaacccgacaggactataaagataccaggcgtt |
| tccccctggaagctccctcgtgcgctctcctgttccgaccctgccgctta |
| ccggatacctgtccgcctttctcccatcgggaagcgtggcgctttctcata |
| gctcacgctgtaggtatctcagttcggtgtaggtcgttcgctccaagctg |
| ggctgtgtgcacgaaccccccgttcagcccgaccgctgcgccttatccgg |
| taactatcgtatgagtccaacccggtaagacacgacttatcgccactggc |
| agcagccactggtaacaggattagcagagcgaggtatgtaggcggtgcta |
| cagagttcttgaagtggtggcctaactacggctacactagaagaacagta |
| tttggtatctgcgctctgctgaagccagttaccttcggaaaaagagttgg |
| tagctcttgatccggcaaacaaaccaccgctggtagcggtttttttgttt |
| gcaagcagcagattacgcgcagaaaaaaaggatctcaagaagatcctttg |
| atcttttctacggggtctgacgctcagtggaacgaaaactcacgttaagg |
| gattttggtcatgagattatcaaaaaggatcttcacctagatccttttaa |
| attaaaaatgaagttttaaatcaatctaaagtatatatgagtaaacttgg |

TABLE 26-continued

| Sequence of pZ147-BvCas12b-sgRNA-scaffold |
|---|
| tctgacagttaccaatgcttaatcagtgaggcacctatctcagcgatctg |
| tctatttcgttcatccatagttgcctgactccccgtcgtgtagataacta |
| cgatacgggagggcttaccatctggccccagtgctgcaatgataccgcga |
| gacccacgctcaccggctccagatttatcagcaataaaccagccagccgg |
| aagggccgagcgcagaagtggtcctgcaactttatccgcctccatccagt |
| ctattaattgttgccgggaagctagagtaagtagttcgccagttaatagt |
| ttgcgcaacgttgttgccattgctacaggcatcgtggtgtcacgctcgtc |
| gtttggtatggcttcattcagctccggttcccaacgatcaaggcgagtta |
| catgatcccccatgttgtgcaaaaaagcggttagctccttcggtcctccg |
| atcgttgtcagaagtaagttggccgcagtgttatcactcatggttatggc |
| agcactgcataattctatactgtcatgccatccgtaagatgcttttctgt |
| gactggtgagtactcaaccaagtcattctgagaatagtgtatgcggcgac |
| cgagttgctcttgcccggcgtcaatacgggataataccgcgccacatagc |
| agaactttaaaagtgctcatcattggaaaacgttatcggggcgaaaactc |
| tcaaggatcttaccgctgttgagatccagttcgatgtaacccactcgtgc |
| acccaactgatcttcagcatcttttactttcaccagcgtttctgggtgag |
| caaaaacaggaaggcaaaatgccgcaaaaaagggaataagggcgacacgg |
| aaatgttgaatactcatactatcattttcaatattattgaagcatttatc |
| agggttattgtctcatgagcggatacatatttgaatgtatttagaaaaat |
| aaacaaataggggttccgcgcacatttccccgaaaagtgccacctgacgt |
| cgacggatcgggagatctcccgatcccctatggtgcactctcagtacaat |
| ctgctctgatgccgcatagttaagccagtatctgctccctgcttgtgtgt |
| tggaggtcgctgagtagtgcgcgagcaaaatttaagctacaacaaggcaa |
| ggcttgaccgacTTAATTAAgagggcctatttcccatgattccttcatat |
| ttgcatatacgatacaaggctgttagagagataattggaattaatttgac |
| tgtaaacacaaagatattagtacaaaatacgtgacgtagaaagtaataat |
| ttatgggtagtttgcagttttaaaattatgttttaaaatggactatcata |
| tgcttaccgtaacttgaaagtatttcgatttatggattatatatcttgtg |
| gaaaggacgaaacaccgGACCTATAGGGTCAATGAATCTGTGCGTGTGCC |
| ATAAGTAATTAAAAATTACCCACCACAGGAGCACCTGAAAACAGGTGCTT |
| GGCACggagacgatatatcgtctatttttcaattgcatgaagaatctga |
| tagggttaggcgttttgcgctgcttcgcgatgtacgggccagatatacgc |
| gttgacattgattattgactagttattaatagtaatcaattacggggtca |
| ttagttcatagcccatatatggagttccgcgttacataacttacggtaaa |
| tggcccgcctggctgaccgcccaacgacccccgcccattgacgtcaataa |
| tgacgtatgttcccatagtaacgccaatagggactttccattgacgtcaa |
| tgggtggagtatttacggtaaactgcccacttggcagtacatcaagtgta |
| tcatatgccaagtacgccccctattgacgtcaatgacggtaaatggcccg |
| cctggcattatgcccagtacatgaccttatgggactttcctacttggcag |

TABLE 26-continued

| Sequence of pZ147-BvCas12b-sgRNA-scaffold |
|---|
| tacatctacgtattagtcatcgctattaccatggtgatgcggttttggca |
| gtacatcaatgggcgtggatagcggtttgactcacggggatttccaagtc |
| tccaccccattgacgtcaatgggagtttgttttggcaccaaaatcaacgg |
| gactttccaaaatgtcgtaacaactccgccccattgacgcaaatgggcgg |
| taggcgtgtacggtgggaggtctatataagcagagctctctggctaacta |
| gagaacccactgcttactggcttatcgaaattaatacgactcactatagg |
| gagacccaagctggctagcgtttaaacttaAGCTTGCCGGTgccaccatg |
| GTGAGCAAGGGCGAGGAGGATAACATGGCCATCATCAAGGAGTTCATGCG |
| CTTCAAGGTGCACATGGAGGGCTCCGTGAACGGCCACGAGTTCGAGATCG |
| AGGGCGAGGGCGAGGGCCGCCCCTACGAGGGCACCCAGACCGCCAAGCTG |
| AAGGTGACCAAGGGTGGCCCCCTGCCCTTCGCCTGGGACATCCTGTCCCC |
| TCAGTTCATGTACGGCTCCAAGGCCTACGTGAAGCACCCCGCCGACATCC |
| CCGACTACTTGAAGCTGTCCTTCCCCGAGGGCTTCAAGTGGGAGCGCGTG |
| ATGAACTTCGAGGACGGCGGCGTGGTGACCGTGACCCAGGACTCCTCCCT |
| GCAGGACGGCGAGTTCATCTACAAGGTGAAGCTGCGCGGCACCAACTTCC |
| CCTCCGACGGCCCCGTAATGCAGAAGAAGACCATGGGCTGGGAGGCCTCC |
| TCCGAGCGGATGTACCCCGAGGACGGCGCCCTGAAGGGCGAGATCAAGCA |
| GAGGCTGAAGCTGAAGGACGGCGGCCACTACGACGCTGAGGTCAAGACCA |
| CCTACAAGGCCAAGAAGCCCGTGCAGCTGCCCGGCGCCTACAACGTCAAC |
| ATCAAGTTGGACATCACCTCCCACAACGAGGACTACACCATCGTGGAACA |
| GTACGAACGCGCCGAGGGCCGCCACTCCACCGGCGGCATGGACGAGCTGT |
| ACAAGtacccatacgatgttccagattacgctTAAGaattctgcagatat |
| ccagcacagtggcggccgctcgagtctagagggcccgtttaaacccgctg |
| atcagcctcgactgtgccttctagttgccagccatctgttgtttgcccct |
| cccccgtgccttccttgaccctggaaggtgccactcccactgtcctttcc |
| taataaaatgaggaaattgcatcgcattgtctgagtaggtgtcattctat |
| tctggggggtggggtggggcaggacagcaagggggaggattgggaagaca |
| atagcaggcatgctggggatgcggtgggctctatggcttctgaggcggaa |
| agaaccagctggggctctagggggtatccccacgcgccctgtagcggcgc |
| attaagcgcggcgggtgtggtggttacgcgcagcgtgaccgctacacttg |
| ccagcgccctagcgcccgctcctttcgctttcttcccttcctttctcgcc |
| acgttcgccggattccccgtcaagctctaaatcggggctccattagggt |
| tccgatttagtgattacggcacctcgaccccaaaaaacttgattagggtg |
| atggttcacgtagtgggccatcgccctgatagacggtttttcgccctttg |
| acgttggagtccacgttctttaatagtggactcttgttccaaactggaac |
| aacactcaaccctatctcggtctattcttttgatttataagggattttgc |
| cgatttcggcctattggttaaaaaatgagctgatttaacaaaaatttaac |
| gcgaattaattctgtggaatgtgtgtcagttagggtgtggaaagtcccca |
| ggctccccagcaggcagaagtatgcaaagcatgcatctcaattagtcagc |

TABLE 26-continued

| Sequence of pZ147-BvCas12b-sgRNA-scaffold |
|---|
| aaccaggtgtggaaagtccccaggctccccagcaggcagaagtatgcaaa |
| gcatgcatctcaattagtcagcaaccatagtcccgcccctaactccgccc |
| atcccgcccctaactccgcccagttccgcccattctccgccccatggctg |
| actaattttttttatttatgcagaggccgaggccgcctctgcctctgagc |
| tattccagaagtagtgaggaggcttttttggaggcctaggcttttgcaaa |
| aagctcccgggagcttgtatatccattttcggatctgatcaagagacagg |
| atgaggatcgtttcgcatgattgaacaagatggattgcacgcaggttctc |
| cggccgcttgggtggagaggctattcggctatgactgggcacaacagaca |
| atcggctgctctgatgccgccgtgttccggctgtcagcgcaggggcgccc |
| ggttatttttgtcaagaccgacctgtccggtgccctgaatgaactgcagga |
| cgaggcagcgcggctatcgtggctggccacgacgggcgttccttgcgcag |
| ctgtgctcgacgttgtcactgaagcgggaagggactggctgctattgggc |
| gaagtgccggggcaggatctcctgtcatctc (SEQ ID NO: 587) |

Example 17

Figure 33:
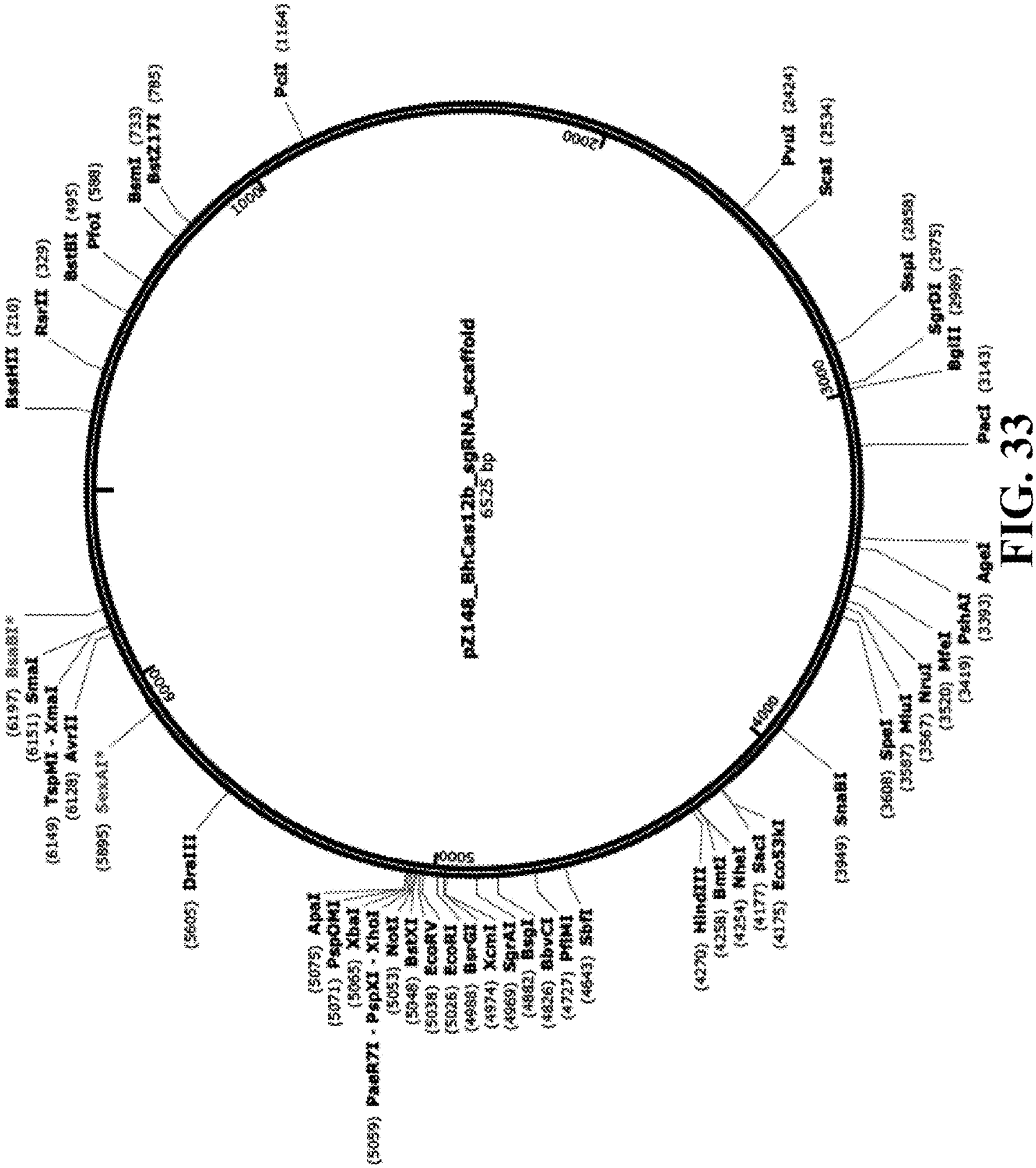
FIG. 33 shows a plasmid map of an exemplary construct pZ148-BhCas12b-sgRNA-scaffold containing BhCas12b sgRNA scaffold.

Plasmid pZ148-BhCas12b-sgRNA-scaffold containing BhCas12b sgRNA scaffold was generated. A map of the plasmid is shown in FIG. 33 and the sequence of the cloned construct is shown in Table 27 below.

TABLE 27

| Sequence of pZ148-BhCas12b-sgRNA-scaffold |
|---|
| accttgacctgccgagaaagtatccatcatggctgatgcaatgcggcggc |
| tgcatacgcttgatccggctacctgcccattcgaccaccaagcgaaacat |
| cgcatcgagcgagcacgtactcggatggaagccggtatgtcgatcaggat |
| gatctggacgaagagcatcaggggctcgcgccagccgaactgttcgccag |
| gctcaaggcgcgcatgcccgacggcgaggatctcgtcgtgacccatggcg |
| atgcctgatgccgaatatcatggtggaaaatggccgatttctggattcat |
| cgactgtggccggctgggtgtggcggaccgctatcaggacatagcgttgg |
| ctacccgtgatattgctgaagagcttggcggcgaatgggctgaccgcttc |
| ctcgtgattacggtatcgccgctcccgattcgcagcgcatcgcatctatc |
| gccttatgacgagttatctgagcgggactaggggttcgaaatgaccgacc |
| aagcgacgcccaacctgccatcacgagatttcgattccaccgccgcatct |
| atgaaaggttgggatcggaatcgttttccgggacgccggctggatgatcc |
| tccagcgcggggatacatgctggagttcttcgcccaccccaacttgttta |
| ttgcagatataatggttacaaataaagcaatagcatcacaaatttcacaa |
| ataaagcatttttttcactgcattctagttgtggtttgtccaaactcatc |
| aatgtatcttatcatgtagtataccgtcgacactagctagagcttggcgt |
| aatcatggtcatagagtttcctgtgtgaaattgttatccgctcacaattc |
| cacacaacatacgagccggaagcataaagtgtaaagcctggggtgcctaa |
| tgagtgagctaactcacattaattgcgttgcgctcactgcccgattccag |

TABLE 27-continued

| Sequence of pZ148-BhCas12b-sgRNA-scaffold |
|---|
| tcgggaaacctgtcgtgccagagcattaatgaatcggccaacgcgcgggg |
| agaggcggtttgcgtattgggcgctatccgatcctcgctcactgactcgc |
| tgcgctcggtcgttcggctgcggcgagcggtatcagctcactcaaaggcg |
| gtaatacggttatccacagaatcaggggataacgcaggaaagaacatgtg |
| agcaaaaggccagcaaaaggccaggaaccgtaaaaaggccgcgttgctgg |
| cgtttttccataggctccgcccccctgacgagcatcacaaaaatcgacgc |
| tcaagtcagaggtggcgaaacccgacaggactataaagataccaggcgtt |
| tccccctggaagctccctcgtgcgctctcctgttccgaccctgccgctta |
| ccggatacctgtccgcctttctcccatcgggaagcgtggcgctttctcata |
| gctcacgctgtaggtatctcagttcggtgtaggtcgttcgctccaagctg |
| ggctgtgtgcacgaaccccccgttcagcccgaccgctgcgccttatccgg |
| taactatcgtatgagtccaacccggtaagacacgacttatcgccactggc |
| agcagccactggtaacaggattagcagagcgaggtatgtaggcggtgcta |
| cagagttcttgaagtggtggcctaactacggctacactagaagaacagta |
| tttggtatctgcgctctgctgaagccagttaccttcggaaaaagagttgg |
| tagctcttgatccggcaaacaaaccaccgctggtagcggtttttttgttt |
| gcaagcagcagattacgcgcagaaaaaaaggatctcaagaagatcctttg |
| atcttttctacggggtctgacgctcagtggaacgaaaactcacgttaagg |
| gattttggtcatgagattatcaaaaaggatcttcacctagatccttttaa |
| attaaaaatgaagttttaaatcaatctaaagtatatatgagtaaacttgg |
| tctgacagttaccaatgcttaatcagtgaggcacctatctcagcgatctg |
| tctatttcgttcatccatagttgcctgactccccgtcgtgtagataacta |
| cgatacgggagggcttaccatctggccccagtgctgcaatgataccgcga |
| gacccacgctcaccggctccagatttatcagcaataaaccagccagccgg |
| aagggccgagcgcagaagtggtcctgcaactttatccgcctccatccagt |
| ctattaattgttgccgggaagctagagtaagtagttcgccagttaatagt |
| ttgcgcaacgttgttgccattgctacaggcatcgtggtgtcacgctcgtc |
| gtttggtatggcttcattcagctccggttcccaacgatcaaggcgagtta |
| catgatcccccatgttgtgcaaaaaagcggttagctccttcggtcctccg |
| atcgttgtcagaagtaagttggccgcagtgttatcactcatggttatggc |
| agcactgcataattctatactgtcatgccatccgtaagatgcttttctgt |
| gactggtgagtactcaaccaagtcattctgagaatagtgtatgcggcgac |
| cgagttgctcttgcccggcgtcaatacgggataataccgcgccacatagc |
| agaactttaaaagtgctcatcattggaaaacgttatcggggcgaaaactc |
| tcaaggatcttaccgctgttgagatccagttcgatgtaacccactcgtgc |
| acccaactgatcttcagcatcttttactttcaccagcgtttctgggtgag |
| caaaaacaggaaggcaaaatgccgcaaaaaagggaataagggcgacacgg |
| aaatgttgaatactcatactcttcctttttcaatattattgaagcatttatc |
| agggttattgtctcatgagcggatacatatttgaatgtatttagaaaaat |

TABLE 27-continued

| Sequence of pZ148-BhCas12b-sgRNA-scaffold |
|---|
| aaacaaataggggttccgcgcacatttccccgaaaagtgccacctgacgt |
| cgacggatcgggagatctcccgatcccctatggtgcactctcagtacaat |
| ctgctctgatgccgcatagttaagccagtatctgctccctgcttgtgtgt |
| tggaggtcgctgagtagtgcgcgagcaaaatttaagctacaacaaggcaa |
| ggcttgaccgacTTAATTAAgagggcctatttcccatgattccttcatat |
| ttgcatatacgatacaaggctgttagagagataattggaattaatttgac |
| tgtaaacacaaagatattagtacaaaatacgtgacgtagaaagtaataat |
| ttatgggtagtttgcagttttaaaattatgttttaaaatggactatcata |
| tgcttaccgtaacttgaaagtatttcgatttatggattatatatcttgtg |
| gaaaggacgaaacaccgGTTCTGTCTTTTGGTCAGGACAACCGTCTAGCT |
| ATAAGTGCTGCAGGGTGTGAGAAACTCCTATTGCTGGACGATGTCTCTTA |
| CGAGGCATTAGCACggagacgatatatcgtctatttttttcaattgcatga |
| agaatctgatagggttaggcgttttgcgctgatcgcgatgtacgggccag |
| atatacgcgttgacattgattattgactagttattaatagtaatcaatta |
| cggggtcattagttcatagcccatatatggagttccgcgttacataactt |
| acggtaaatggcccgcctggctgaccgcccaacgacccccgcccattgac |
| gtcaataatgacgtatgttcccatagtaacgccaatagggactttccatt |
| gacgtcaatgggtggagtatttacggtaaactgcccacttggcagtacat |
| caagtgtatcatatgccaagtacgccccctattgacgtcaatgacggtaa |
| atggcccgcctggcattatgcccagtacatgaccttatgggactttccta |
| cttggcagtacatctacgtattagtcatcgctattaccatggtgatgcgg |
| ttttggcagtacatcaatgggcgtggatagcggtttgactcacggggatt |
| tccaagtctccaccccattgacgtcaatgggagtttgttttggcaccaaa |
| atcaacgggactttccaaaatgtcgtaacaactccgccccattgacgcaa |
| atgggcggtaggcgtgtacggtgggaggtctatataagcagagctctctg |
| gctaactagagaacccactgcttactggcttatcgaaattaatacgactc |
| actatagggagacccaagctggctagcgtttaaacttaAGCTTGCCGGTg |
| ccaccatgGTGAGCAAGGGCGAGGAGGATAACATGGCCATCATCAAGGAG |
| TTCATGCGCTTCAAGGTGCACATGGAGGGCTCCGTGAACGGCCACGAGTT |
| CGAGATCGAGGGCGAGGGCGAGGGCCGCCCCTACGAGGGCACCCAGACCG |
| CCAAGCTGAAGGTGACCAAGGGTGGCCCCCTGCCCTTCGCCTGGGACATC |
| CTGTCCCCTCAGTTCATGTACGGCTCCAAGGCCTACGTGAAGCACCCCGC |
| CGACATCCCCGACTACTTGAAGCTGTCCTTCCCCGAGGGCTTCAAGTGGG |
| AGCGCGTGATGAACTTCGAGGACGGCGGCGTGGTGACCGTGACCCAGGAC |
| TCCTCCCTGCAGGACGGCGAGTTCATCTACAAGGTGAAGCTGCGCGGCAC |
| CAACTTCCCCTCCGACGGCCCCGTAATGCAGAAGAAGACCATGGGCTGGG |
| AGGCCTCCTCCGAGCGGATGTACCCCGAGGACGGCGCCCTGAAGGGCGAG |
| ATCAAGCAGAGGCTGAAGCTGAAGGACGGCGGCCACTACGACGCTGAGGT |
| CAAGACCACCTACAAGGCCAAGAAGCCCGTGCAGCTGCCCGGCGCCTACA |
| ACGTCAACATCAAGTTGGACATCACCTCCCACAACGAGGACTACACCATC |
| GTGGAACAGTACGAACGCGCCGAGGGCCGCCACTCCACCGGCGGCATGGA |
| CGAGCTGTACAAGtacccatacgatgttccagattacgctTAAGaattct |
| gcagatatccagcacagtggcggccgctcgagtctagagggcccgtttaa |
| acccgctgatcagcctcgactgtgccttctagttgccagccatctgttgt |
| ttgcccctcccccgtgccttccttgaccctggaaggtgccactcccactg |
| tcctttcctaataaaatgaggaaattgcatcgcattgtctgagtaggtgt |
| cattctattctggggggtggggtggggcaggacagcaagggggaggattg |
| ggaagacaatagcaggcatgctggggatgcggtgggctctatggcttctg |
| aggcggaaagaaccagctggggctctagggggtatccccacgcgccctgt |
| agcggcgcattaagcgcggcgggtgtggtggttacgcgcagcgtgaccgc |
| tacacttgccagcgccctagcgcccgctcctttcgctttcttccatcatt |
| ctcgccacgttcgccggattccccgtcaagctctaaatcgggggctccct |
| ttagggttccgatttagtgctttacggcacctcgaccccaaaaaacttga |
| ttagggtgatggttcacgtagtgggccatcgccctgatagacggtttttc |
| gccctttgacgttggagtccacgttctttaatagtggactcttgttccaa |
| actggaacaacactcaaccctatctcggtctattcttttgatttataagg |
| gattttgccgatttcggcctattggttaaaaaatgagctgatttaacaaa |
| aatttaacgcgaattaattctgtggaatgtgtgtcagttagggtgtggaa |
| agtccccaggctccccagcaggcagaagtatgcaaagcatgcatctcaat |
| tagtcagcaaccaggtgtggaaagtccccaggctccccagcaggcagaag |
| tatgcaaagcatgcatctcaattagtcagcaaccatagtcccgcccctaa |
| ctccgcccatcccgcccctaactccgcccagttccgcccattctccgccc |
| catggctgactaattttttttatttatgcagaggccgaggccgcctctgc |
| ctctgagctattccagaagtagtgaggaggcttttttggaggcctaggct |
| tttgcaaaaagctcccgggagcttgtatatccattttcggatctgatcaa |
| gagacaggatgaggatcgtttcgcatgattgaacaagatggattgcacgc |
| aggttctccggccgcttgggtggagaggctattcggctatgactgggcac |
| aacagacaatcggctgctctgatgccgccgtgttccggctgtcagcgcag |
| gggcgcccggttctttttgtcaagaccgacctgtccggtgccctgaatga |
| actgcaggacgaggcagcgcggctatcgtggctggccacgacgggcgttc |
| cttgcgcagctgtgctcgacgttgtcactgaagcgggaagggactggctg |
| ctattgggcgaagtgccggggcaggatctcctgtcatctc |
| (SEQ ID NO: 588) |

Figure 34:
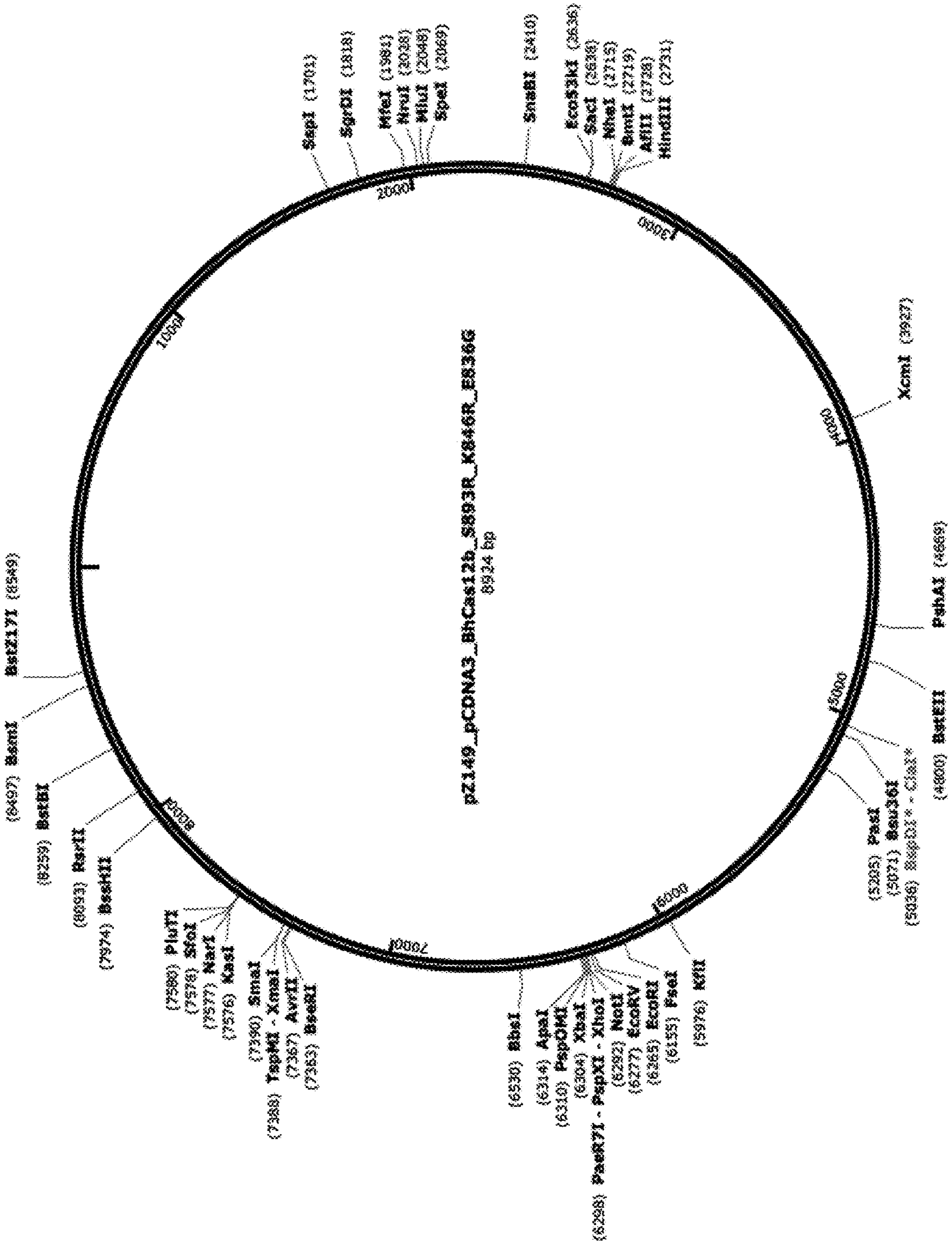
FIG. 34 shows a plasmid map of an exemplary construct pZ149-BhCas12b-S893R-K846R-E836G containing BhCas12b with mutations at S893, K846, and E836.

Plasmid pZ149-BhCas12b-S893R-K846R-E836G containing BhCas12b with mutations at S893, K846, and E836 was generated. A map of the plasmid is shown in FIG. 34 and the sequence of the cloned construct is shown in Table 28 below.

TABLE 28

| Sequence of pcDNA3-PlancCas12b |
|---|
| AGAACATGTGAGCAAAAGGCCAGCAAAAGGCCAGGAACCGTAAAAAGGCCGCGTTGCTGGCGTTTTTCCATAGGC |
| TCCGCCCCCCTGACGAGCATCACAAAAATCGACGCTCAAGTCAGAGGTGGCGAAACCCGACAGGACTATAAAGAT |
| ACCAGGCGTTTCCCCCTGGAAGCTCCCTCGTGCGCTCTCCTGTTCCGACCCTGCCGCTTACCGGATACCTGTCCG |
| CCTTTCTCCCTTCGGGAAGCGTGGCGCTTTCTCATAGCTCACGCTGTAGGTATCTCAGTTCGGTGTAGGTCGTTC |
| GCTCCAAGCTGGGCTGTGTGCACGAACCCCCCGTTCAGCCCGACCGCTGCGCCTTATCCGGTAACTATCGTCTTG |
| AGTCCAACCCGGTAAGACACGACTTATCGCCACTGGCAGCAGCCACTGGTAACAGGATTAGCAGAGCGAGGTATG |
| TAGGCGGTGCTACAGAGTTCTTGAAGTGGTGGCCTAACTACGGCTACACTAGAAGAACAGTATTTGGTATCTGCG |
| CTCTGCTGAAGCCAGTTACCTTCGGAAAAAGAGTTGGTAGCTCTTGATCCGGCAAACAAACCACCGCTGGTAGCG |
| GTGGTTTTTTTGTTTGCAAGCAGCAGATTACGCGCAGAAAAAAAGGATCTCAAGAAGATCCTTTGATCTTTTCTA |
| CGGGGTCTGACGCTCAGTGGAACGAAAACTCACGTTAAGGGATTTTGGTCATGAGATTATCAAAAAGGATCTTCA |
| CCTAGATCCTTTTAAATTAAAAATGAAGTTTTAAATCAATCTAAAGTATATATGAGTAAACTTGGTCTGACAGTT |
| ACCAATGCTTAATCAGTGAGGCACCTATCTCAGCGATCTGTCTATTTCGTTCATCCATAGTTGCCTGACTCCCCG |
| TCGTGTAGATAACTACGATACGGGAGGGCTTACCATCTGGCCCCAGTGCTGCAATGATACCGCGAGACCCACGCT |
| CACCGGCTCCAGATTTATCAGCAATAAACCAGCCAGCCGGAAGGGCCGAGCGCAGAAGTGGTCCTGCAACTTTAT |
| CCGCCTCCATCCAGTCTATTAATTGTTGCCGGGAAGCTAGAGTAAGTAGTTCGCCAGTTAATAGTTTGCGCAACG |
| TTGTTGCCATTGCTACAGGCATCGTGGTGTCACGCTCGTCGTTTGGTATGGCTTCATTCAGCTCCGGTTCCCAAC |
| GATCAAGGCGAGTTACATGATCCCCCATGTTGTGCAAAAAAGCGGTTAGCTCCTTCGGTCCTCCGATCGTTGTCA |
| GAAGTAAGTTGGCCGCAGTGTTATCACTCATGGTTATGGCAGCACTGCATAATTCTCTTACTGTCATGCCATCCG |
| TAAGATGCTTTTCTGTGACTGGTGAGTACTCAACCAAGTCATTCTGAGAATAGTGTATGCGGCGACCGAGTTGCT |
| CTTGCCCGGCGTCAATACGGGATAATACCGCGCCACATAGCAGAACTTTAAAAGTGCTCATCATTGGAAAACGTT |
| CTTCGGGGCGAAAACTCTCAAGGATCTTACCGCTGTTGAGATCCAGTTCGATGTAACCCACTCGTGCACCCAACT |
| GATCTTCAGCATCTTTTACTTTCACCAGCGTTTCTGGGTGAGCAAAAACAGGAAGGCAAAATGCCGCAAAAAAGG |
| GAATAAGGGCGACACGGAAATGTTGAATACTCATACTCTTCCTTTTTCAATATTATTGAAGCATTTATCAGGGTT |
| ATTGTCTCATGAGCGGATACATATTTGAATGTATTTAGAAAAATAAACAAATAGGGGTTCCGCGCACATTTCCCC |
| GAAAAGTGCCACCTGACGTCGACGGATCGGGAGATCTCCCGATCCCCTATGGTGCACTCTCAGTACAATCTGCTC |
| TGATGCCGCATAGTTAAGCCAGTATCTGCTCCCTGCTTGTGTGTTGGAGGTCGCTGAGTAGTGCGCGAGCAAAAT |
| TTAAGCTACAACAAGGCAAGGCTTGACCGACAATTGCATGAAGAATCTGCTTAGGGTTAGGCGTTTTGCGCTGCT |
| TCGCGATGTACGGGCCAGATATACGCGTTGACATTGATTATTGACTAGTTATTAATAGTAATCAATTACGGGGTC |
| ATTAGTTCATAGCCCATATATGGAGTTCCGCGTTACATAACTTACGGTAAATGGCCCGCCTGGCTGACCGCCCAA |
| CGACCCCCGCCCATTGACGTCAATAATGACGTATGTTCCCATAGTAACGCCAATAGGGACTTTCCATTGACGTCA |
| ATGGGTGGAGTATTTACGGTAAACTGCCCACTTGGCAGTACATCAAGTGTATCATATGCCAAGTACGCCCCCTAT |
| TGACGTCAATGACGGTAAATGGCCCGCCTGGCATTATGCCCAGTACATGACCTTATGGGACTTTCCTACTTGGCA |
| GTACATCTACGTATTAGTCATCGCTATTACCATGGTGATGCGGTTTTGGCAGTACATCAATGGGCGTGGATAGCG |
| GTTTGACTCACGGGGATTTCCAAGTCTCCACCCCATTGACGTCAATGGGAGTTTGTTTTGGCACCAAAATCAACG |
| GGACTTTCCAAAATGTCGTAACAACTCCGCCCCATTGACGCAAATGGGCGGTAGGCGTGTACGGTGGGAGGTCTA |
| TATAAGCAGAGCTCTCTGGCTAACTAGAGAACCCACTGCTTACTGGCTTATCGAAATTAATACGACTCACTATAG |
| GGAGACCCAAGCTGGCTAGCGTTTAAACTTAAGCTTGCCACCATGGCCCCAAAGAAGAAGCGGAAGGTCGGTATC |
| CACGGAGTCCCAGCAGCCGGATCCGCCACCAGATCCTTCATCCTGAAGATCGAGCCCAACGAGGAAGTGAAGAAA |
| GGCCTCTGGAAAACCCACGAGGTGCTGAACCACGGAATCGCCTACTACATGAATATCCTGAAGCTGATCCGGCAA |

TABLE 28-continued

| Sequence of pcDNA3-PlancCas12b |
|---|
| GAGGCCATCTACGAGCACCACGAGCAGGACCCCAAGAATCCCAAGAAGGTGTCCAAGGCCGAGATCCAGGCCGAG |
| CTGTGGGATTTCGTGCTGAAGATGCAGAAGTGCAACAGCTTCACACACGAGGTGGACAAGGACGAGGTGTTCAAC |
| ATCCTGAGAGAGCTGTACGAGGAACTGGTGCCCAGCAGCGTGGAAAAGAAGGGCGAAGCCAACCAGCTGAGCAAC |
| AAGTTTCTGTACCCTCTGGTGGACCCCAACAGCCAGTCTGGAAAGGGAACAGCCAGCAGCGGCAGAAAGCCCAGA |
| TGGTACAACCTGAAGATTGCCGGCGATCCCTCCTGGGAAGAAGAGAAGAAGAAGTGGGAAGAAGATAAGAAAAAG |
| GACCCGCTGGCCAAGATCCTGGGCAAGCTGGCTGAGTACGGACTGATCCCTCTGTTCATCCCCTACACCGACAGC |
| AACGAGCCCATCGTGAAAGAAATCAAGTGGATGGAAAAGTCCCGGAACCAGAGCGTGCGGCGGCTGGATAAGGAC |
| ATGTTCATTCAGGCCCTGGAACGGTTCCTGAGCTGGGAGAGCTGGAACCTGAAAGTGAAAGAGGAATACGAGAAG |
| GTCGAGAAAGAGTACAAGACCCTGGAAGAGAGGATCAAAGAGGACATCCAGGCTCTGAAGGCTCTGGAACAGTAT |
| GAGAAAGAGCGGCAAGAACAGCTGCTGCGGGACACCCTGAACACCAACGAGTACCGGCTGAGCAAGAGAGGCCTT |
| AGAGGCTGGCGGGAAATCATCCAGAAATGGCTGAAAATGGACGAGAACGAGCCCTCCGAGAAGTACCTGGAAGTG |
| TTCAAGGACTACCAGCGGAAGCACCCTAGAGAGGCCGGCGATTACAGCGTGTACGAGTTCCTGTCCAAGAAAGAG |
| AACCACTTCATCTGGCGGAATCACCCTGAGTACCCCTACCTGTACGCCACCTTCTGCGAGATCGACAAGAAAAAG |
| AAGGACGCCAAGCAGCAGGCCACCTTCACACTGGCCGATCCTATCAATCACCCTCTGTGGGTCCGATTCGAGGAA |
| AGAAGCGGCAGCAACCTGAACAAGTACAGAATCCTGACCGAGCAGCTGCACACCGAGAAGCTGAAGAAAAAGCTG |
| ACAGTGCAGCTGGACCGGCTGATCTACCCTACAGAATCTGGCGGCTGGGAAGAGAAGGGCAAAGTGGACATTGTG |
| CTGCTGCCCAGCCGGCAGTTCTACAACCAGATCTTCCTGGACATCGAGGAAAAGGGCAAGCACGCCTTCACCTAC |
| AAGGATGAGAGCATCAAGTTCCCTCTGAAGGGCACACTCGGCGGAGCCAGAGTGCAGTTCGACAGAGATCACCTG |
| AGAAGATACCCTCACAAGGTGGAAAGCGGCAACGTGGGCAGAATCTACTTCAACATGACCGTGAACATCGAGCCT |
| ACAGAGTCCCCAGTGTCCAAGTCTCTGAAGATCCACCGGGACGACTTCCCCAAGGTGGTCAACTTCAAGCCCAAA |
| GAACTGACCGAGTGGATCAAGGACAGCAAGGGCAAGAAACTGAAGTCCGGCATCGAGTCCCTGGAAATCGGCCTG |
| AGAGTGATGAGCATCGACCTGGGACAGAGACAGGCCGCTGCCGCCTCTATTTTCGAGGTGGTGGATCAGAAGCCC |
| GACATCGAAGGCAAGCTGTTTTTCCCAATCAAGGGCACCGAGCTGTATGCCGTGCACAGAGCCAGCTTCAACATC |
| AAGCTGCCCGGCGAGACACTGGTCAAGAGCAGAGAAGTGCTGCGGAAGGCCAGAGAGGACAATCTGAAACTGATG |
| AACCAGAAGCTCAACTTCCTGCGGAACGTGCTGCACTTCCAGCAGTTCGAGGACATCACCGAGAGAGAGAAGCGG |
| GTCACCAAGTGGATCAGCAGACAAGAGAACAGCGACGTGCCCCTGGTGTACCAGGATGAGCTGATCCAGATCCGC |
| GAGCTGATGTACAAGCCTTACAAGGACTGGGTCGCCTTCCTGAAGCAGCTCCACAAGAGACTGGAAGTCGAGATC |
| GGCAAAGAAGTGAAGCACTGGCGGAAGTCCCTGAGCGACGGAAGAAAGGGCCTGTACGGCATCTCCCTGAAGAAC |
| ATCGACGAGATCGATCGGACCCGGAAGTTCCTGCTGAGATGGTCCCTGAGGCCTACCGAACCTGGCGAAGTGCGT |
| AGACTGGAACCCGGCCAGAGATTCGCCATCGACCAGCTGAATCACCTGAACGCCCTGAAAGAAGATCGGCTGAAG |
| AAGATGGCCAACACCATCATCATGCACGCCCTGGGCTACTGCTACGACGTGCGGAAGAAGAAATGGCAGGCTAAG |
| AACCCCGCCTGCCAGATCATCCTGTTCGAGGATCTGAGCAACTACAACCCCTACGGAGAAAGGTCCCGCTTCGAG |
| AACAGCCGGCTCATGAAGTGGTCCAGACGCGAGATCCCCAGACAGGTTGCACTGCAGGGCGAGATCTATGGCCTG |
| CAAGTGGGAGAAGTGGGCGCTCAGTTCAGCAGCAGATTCCACGCCAAGACAGGCAGCCCTGGCATCAGATGTCGG |
| GTCGTGACCAAAGAGAAGCTGCAGGACAATCGGTTCTTCAAGAATCTGCAGAGAGAGGGCAGACTGACCCTGGAC |
| AAAATCGCCGTGCTGAAAGAGGGCGATCTGTACCCAGACAAAGGCGGCGAGAAGTTCATCAGCCTGAGCAAGGAT |
| CGGAAGTGCGTGACCACACACGCCGACATCAACGCCGCTCAGAACCTGCAGAAGCGGTTCTGGACAAGAACCCAC |
| GGCTTCTACAAGGTGTACTGCAAGGCCTACCAGGTGGACGGCCAGACCGTGTACATCCCTGAGAGCAAGGACCAG |
| AAGCAGAAGATCATCGAAGAGTTCGGCGAGGGCTACTTCATTCTGAAGGACGGGGTGTACGAATGGGTCAACGCC |

TABLE 28-continued

| Sequence of pcDNA3-PlancCas12b |
|---|
| GGCAAGCTGAAAATCAAGAAGGGCAGCTCCAAGCAGAGCAGCAGCGAGCTGGTGGATAGCGACATCCTGAAAGAC |
| AGCTTCGACCTGGCCTCCGAGCTGAAAGGCGAAAAGCTGATGCTGTACAGGGACCCCAGCGGCAATGTGTTCCCC |
| AGCGACAAATGGATGGCCGCTGGCGTGTTCTTCGGAAAGCTGGAACGCATCCTGATCAGCAAGCTGACCAACCAG |
| TACTCCATCAGCACCATCGAGGACGACAGCAGCAAGCAGTCTATGGGATCCAAAAGGCCGGCGGCCACGAAAAAG |
| GCCGGCCAGGCAAAAAAGAAAAAGggatctTACCCATACGATGTTCCAGATTACGCTTATCCCTACGACGTGCCT |
| GATTATGCATACCCATATGATGTCCCCGACTATGCCtaaGAATTCTGCAGATATCCAGCACAGTGGCGGCCGCTC |
| GAGTCTAGAGGGCCCGTTTAAACCCGCTGATCAGCCTCGACTGTGCCTTCTAGTTGCCAGCCATCTGTTGTTTGC |
| CCCTCCCCCGTGCCTTCCTTGACCCTGGAAGGTGCCACTCCCACTGTCCTTTCCTAATAAAATGAGGAAATTGCA |
| TCGCATTGTCTGAGTAGGTGTCATTCTATTCTGGGGGGTGGGGTGGGGCAGGACAGCAAGGGGGAGGATTGGGAA |
| GACAATAGCAGGCATGCTGGGGATGCGGTGGGCTCTATGGCTTCTGAGGCGGAAAGAACCAGCTGGGGCTCTAGG |
| GGGTATCCCCACGCGCCCTGTAGCGGCGCATTAAGCGCGGCGGGTGTGGTGGTTACGCGCAGCGTGACCGCTACA |
| CTTGCCAGCGCCCTAGCGCCCGCTCCTTTCGCTTTCTTCCCTTCCTTTCTCGCCACGTTCGCCGGCTTTCCCCGT |
| CAAGCTCTAAATCGGGGGCTCCCTTTAGGGTTCCGATTTAGTGCTTTACGGCACCTCGACCCCAAAAAACTTGAT |
| TAGGGTGATGGTTCACGTAGTGGGCCATCGCCCTGATAGACGGTTTTTCGCCCTTTGACGTTGGAGTCCACGTTC |
| TTTAATAGTGGACTCTTGTTCCAAACTGGAACAACACTCAACCCTATCTCGGTCTATTCTTTTGATTTATAAGGG |
| ATTTTGCCGATTTCGGCCTATTGGTTAAAAAATGAGCTGATTTAACAAAAATTTAACGCGAATTAATTCTGTGGA |
| ATGTGTGTCAGTTAGGGTGTGGAAAGTCCCCAGGCTCCCCAGCAGGCAGAAGTATGCAAAGCATGCATCTCAATT |
| AGTCAGCAACCAGGTGTGGAAAGTCCCCAGGCTCCCCAGCAGGCAGAAGTATGCAAAGCATGCATCTCAATTAGT |
| CAGCAACCATAGTCCCGCCCCTAACTCCGCCCATCCCGCCCCTAACTCCGCCCAGTTCCGCCCATTCTCCGCCCC |
| ATGGCTGACTAATTTTTTTTATTTATGCAGAGGCCGAGGCCGCCTCTGCCTCTGAGCTATTCCAGAAGTAGTGAG |
| GAGGCTTTTTTGGAGGCCTAGGCTTTTGCAAAAAGCTCCCGGGAGCTTGTATATCCATTTTCGGATCTGATCAAG |
| AGACAGGATGAGGATCGTTTCGCATGATTGAACAAGATGGATTGCACGCAGGTTCTCCGGCCGCTTGGGTGGAGA |
| GGCTATTCGGCTATGACTGGGCACAACAGACAATCGGCTGCTCTGATGCCGCCGTGTTCCGGCTGTCAGCGCAGG |
| GGCGCCCGGTTCTTTTTGTCAAGACCGACCTGTCCGGTGCCCTGAATGAACTGCAGGACGAGGCAGCGCGGCTAT |
| CGTGGCTGGCCACGACGGGCGTTCCTTGCGCAGCTGTGCTCGACGTTGTCACTGAAGCGGGAAGGGACTGGCTGC |
| TATTGGGCGAAGTGCCGGGGCAGGATCTCCTGTCATCTCACCTTGCTCCTGCCGAGAAAGTATCCATCATGGCTG |
| ATGCAATGCGGCGGCTGCATACGCTTGATCCGGCTACCTGCCCATTCGACCACCAAGCGAAACATCGCATCGAGC |
| GAGCACGTACTCGGATGGAAGCCGGTCTTGTCGATCAGGATGATCTGGACGAAGAGCATCAGGGGCTCGCGCCAG |
| CCGAACTGTTCGCCAGGCTCAAGGCGCGCATGCCCGACGGCGAGGATCTCGTCGTGACCCATGGCGATGCCTGCT |
| TGCCGAATATCATGGTGGAAAATGGCCGCTTTTCTGGATTCATCGACTGTGGCCGGCTGGGTGTGGCGGACCGCT |
| ATCAGGACATAGCGTTGGCTACCCGTGATATTGCTGAAGAGCTTGGCGGCGAATGGGCTGACCGCTTCCTCGTGC |
| TTTACGGTATCGCCGCTCCCGATTCGCAGCGCATCGCCTTCTATCGCCTTCTTGACGAGTTCTTCTGAGCGGGAC |
| TCTGGGGTTCGAAATGACCGACCAAGCGACGCCCAACCTGCCATCACGAGATTTCGATTCCACCGCCGCCTTCTA |
| TGAAAGGTTGGGCTTCGGAATCGTTTTCCGGGACGCCGGCTGGATGATCCTCCAGCGCGGGGATCTCATGCTGGA |
| GTTCTTCGCCCACCCCAACTTGTTTATTGCAGCTTATAATGGTTACAAATAAAGCAATAGCATCACAAATTTCAC |
| AAATAAAGCATTTTTTTCACTGCATTCTAGTTGTGGTTTGTCCAAACTCATCAATGTATCTTATCATGTCTGTAT |
| ACCGTCGACCTCTAGCTAGAGCTTGGCGTAATCATGGTCATAGCTGTTTCCTGTGTGAAATTGTTATCCGCTCAC |
| AATTCCACACAACATACGAGCCGGAAGCATAAAGTGTAAAGCCTGGGGTGCCTAATGAGTGAGCTAACTCACATT |
| AATTGCGTTGCGCTCACTGCCCGCTTTCCAGTCGGGAAACCTGTCGTGCCAGCTGCATTAATGAATCGGCCAACG |

TABLE 28-continued

| Sequence of pcDNA3-PlancCas12b |
| --- |
| CGCGGGGAGAGGCGGTTTGCGTATTGGGCGCTCTTCCGCTTCCTCGCTCACTGACTCGCTGCGCTCGGTCGTTCG |
| GCTGCGGCGAGCGGTATCAGCTCACTCAAAGGCGGTAATACGGTTATCCACAGAATCAGGGGATAACGCAGGAA |
| (SEQ ID NO: 589) |

Figure 35:
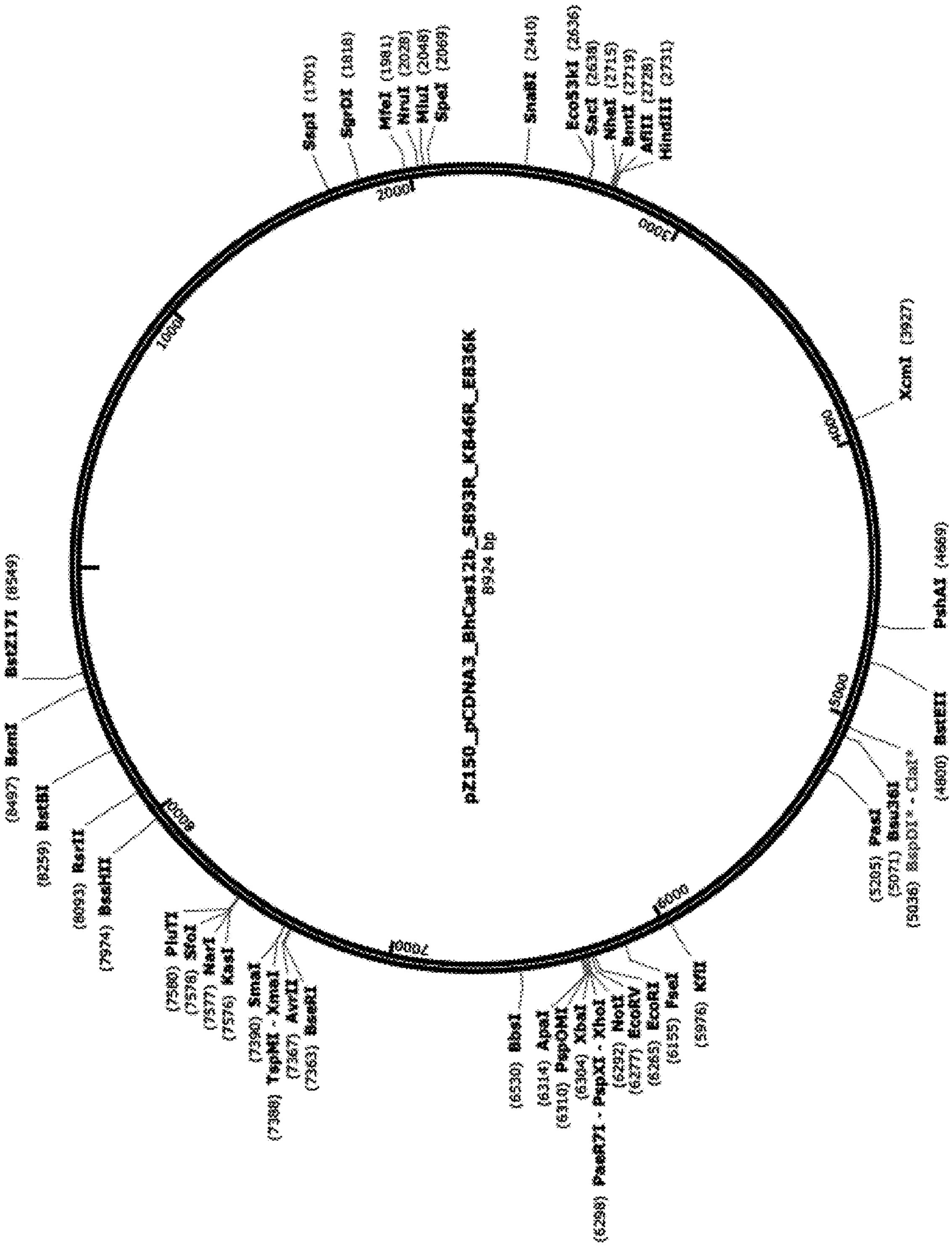
FIG. 35 shows a plasmid map of an exemplary construct pZ150-pCDNA3-BhCas12b-S893R-K846R-E836K containing BhCas12b with mutations at S893, K846, and E836.

Plasmid pZ150-pCDNA3-BhCas12b-S893R-K846R-E836K containing BhCas12b with mutations at S893, K846, and E836 was generated. A map of the plasmid is shown in FIG. 35 and the sequence of the cloned construct is shown in Table 29 below.

TABLE 29

| Sequence of pZ150-pCDNA3-BhCas12b-5893R-K846R-E836K |
| --- |
| AGAACATGTGAGCAAAAGGCCAGCAAAAGGCCAGGAACCGTAAAAAGGCCGCGTTGCTGGCGTTTTTCCATAGGCT |
| CCGCCCCCCTGACGAGCATCACAAAAATCGACGCTCAAGTCAGAGGTGGCGAAACCCGACAGGACTATAAAGATAC |
| CAGGCGTTTCCCCCTGGAAGCTCCCTCGTGCGCTCTCCTGTTCCGACCCTGCCGCTTACCGGATACCTGTCCGCCT |
| TTCTCCCTTCGGGAAGCGTGGCGCTTTCTCATAGCTCACGCTGTAGGTATCTCAGTTCGGTGTAGGTCGTTCGCTC |
| CAAGCTGGGCTGTGTGCACGAACCCCCCGTTCAGCCCGACCGCTGCGCCTTATCCGGTAACTATCGTCTTGAGTCC |
| AACCCGGTAAGACACGACTTATCGCCACTGGCAGCAGCCACTGGTAACAGGATTAGCAGAGCGAGGTATGTAGGCG |
| GTGCTACAGAGTTCTTGAAGTGGTGGCCTAACTACGGCTACACTAGAAGAACAGTATTTGGTATCTGCGCTCTGCT |
| GAAGCCAGTTACCTTCGGAAAAAGAGTTGGTAGCTCTTGATCCGGCAAACAAACCACCGCTGGTAGCGGTGGTTTT |
| TTTGTTTGCAAGCAGCAGATTACGCGCAGAAAAAAAGGATCTCAAGAAGATCCTTTGATCTTTTCTACGGGGTCTG |
| ACGCTCAGTGGAACGAAAACTCACGTTAAGGGATTTTGGTCATGAGATTATCAAAAAGGATCTTCACCTAGATCCT |
| TTTAAATTAAAAATGAAGTTTTAAATCAATCTAAAGTATATATGAGTAAACTTGGTCTGACAGTTACCAATGCTTA |
| ATCAGTGAGGCACCTATCTCAGCGATCTGTCTATTTCGTTCATCCATAGTTGCCTGACTCCCCGTCGTGTAGATAA |
| CTACGATACGGGAGGGCTTACCATCTGGCCCCAGTGCTGCAATGATACCGCGAGACCCACGCTCACCGGCTCCAGA |
| TTTATCAGCAATAAACCAGCCAGCCGGAAGGGCCGAGCGCAGAAGTGGTCCTGCAACTTTATCCGCCTCCATCCAG |
| TCTATTAATTGTTGCCGGGAAGCTAGAGTAAGTAGTTCGCCAGTTAATAGTTTGCGCAACGTTGTTGCCATTGCTA |
| CAGGCATCGTGGTGTCACGCTCGTCGTTTGGTATGGCTTCATTCAGCTCCGGTTCCCAACGATCAAGGCGAGTTAC |
| ATGATCCCCCATGTTGTGCAAAAAAGCGGTTAGCTCCTTCGGTCCTCCGATCGTTGTCAGAAGTAAGTTGGCCGCA |
| GTGTTATCACTCATGGTTATGGCAGCACTGCATAATTCTCTTACTGTCATGCCATCCGTAAGATGCTTTTCTGTGA |
| CTGGTGAGTACTCAACCAAGTCATTCTGAGAATAGTGTATGCGGCGACCGAGTTGCTCTTGCCCGGCGTCAATACG |
| GGATAATACCGCGCCACATAGCAGAACTTTAAAAGTGCTCATCATTGGAAAACGTTCTTCGGGGCGAAAACTCTCA |
| AGGATCTTACCGCTGTTGAGATCCAGTTCGATGTAACCCACTCGTGCACCCAACTGATCTTCAGCATCTTTTACTT |
| TCACCAGCGTTTCTGGGTGAGCAAAAACAGGAAGGCAAAATGCCGCAAAAAAGGGAATAAGGGCGACACGGAAATG |
| TTGAATACTCATACTCTTCCTTTTTCAATATTATTGAAGCATTTATCAGGGTTATTGTCTCATGAGCGGATACATA |
| TTTGAATGTATTTAGAAAAATAAACAAATAGGGGTTCCGCGCACATTTCCCCGAAAAGTGCCACCTGACGTCGACG |
| GATCGGGAGATCTCCCGATCCCCTATGGTGCACTCTCAGTACAATCTGCTCTGATGCCGCATAGTTAAGCCAGTAT |
| CTGCTCCCTGCTTGTGTGTTGGAGGTCGCTGAGTAGTGCGCGAGCAAAATTTAAGCTACAACAAGGCAAGGCTTGA |
| CCGACAATTGCATGAAGAATCTGCTTAGGGTTAGGCGTTTTGCGCTGCTTCGCGATGTACGGGCCAGATATACGCG |
| TTGACATTGATTATTGACTAGTTATTAATAGTAATCAATTACGGGGTCATTAGTTCATAGCCCATATATGGAGTTC |
| CGCGTTACATAACTTACGGTAAATGGCCCGCCTGGCTGACCGCCCAACGACCCCCGCCCATTGACGTCAATAATGA |
| CGTATGTTCCCATAGTAACGCCAATAGGGACTTTCCATTGACGTCAATGGGTGGAGTATTTACGGTAAACTGCCCA |

TABLE 29-continued

| Sequence of pZ150-pCDNA3-BhCas12b-5893R-K846R-E836K |
|---|
| CTTGGCAGTACATCAAGTGTATCATATGCCAAGTACGCCCCCTATTGACGTCAATGACGGTAAATGGCCCGCCTGG |
| CATTATGCCCAGTACATGACCTTATGGGACTTTCCTACTTGGCAGTACATCTACGTATTAGTCATCGCTATTACCA |
| TGGTGATGCGGTTTTGGCAGTACATCAATGGGCGTGGATAGCGGTTTGACTCACGGGGATTTCCAAGTCTCCACCC |
| CATTGACGTCAATGGGAGTTTGTTTTGGCACCAAAATCAACGGGACTTTCCAAAATGTCGTAACAACTCCGCCCCA |
| TTGACGCAAATGGGCGGTAGGCGTGTACGGTGGGAGGTCTATATAAGCAGAGCTCTCTGGCTAACTAGAGAACCCA |
| CTGCTTACTGGCTTATCGAAATTAATACGACTCACTATAGGGAGACCCAAGCTGGCTAGCGTTTAAACTTAAGCTT |
| GCCACCATGGCCCCAAAGAAGAAGCGGAAGGTCGGTATCCACGGAGTCCCAGCAGCCGGATCCGCCACCAGATCCT |
| TCATCCTGAAGATCGAGCCCAACGAGGAAGTGAAGAAAGGCCTCTGGAAAACCCACGAGGTGCTGAACCACGGAAT |
| CGCCTACTACATGAATATCCTGAAGCTGATCCGGCAAGAGGCCATCTACGAGCACCACGAGCAGGACCCCAAGAAT |
| CCCAAGAAGGTGTCCAAGGCCGAGATCCAGGCCGAGCTGTGGGATTTCGTGCTGAAGATGCAGAAGTGCAACAGCT |
| TCACACACGAGGTGGACAAGGACGAGGTGTTCAACATCCTGAGAGAGCTGTACGAGGAACTGGTGCCCAGCAGCGT |
| GGAAAAGAAGGGCGAAGCCAACCAGCTGAGCAACAAGTTTCTGTACCCTCTGGTGGACCCCAACAGCCAGTCTGGA |
| AAGGGAACAGCCAGCAGCGGCAGAAAGCCCAGATGGTACAACCTGAAGATTGCCGGCGATCCCTCCTGGGAAGAAG |
| AGAAGAAGAAGTGGGAAGAAGATAAGAAAAAGGACCCGCTGGCCAAGATCCTGGGCAAGCTGGCTGAGTACGGACT |
| GATCCCTCTGTTCATCCCCTACACCGACAGCAACGAGCCCATCGTGAAAGAAATCAAGTGGATGGAAAAGTCCCGG |
| AACCAGAGCGTGCGGCGGCTGGATAAGGACATGTTCATTCAGGCCCTGGAACGGTTCCTGAGCTGGGAGAGCTGGA |
| ACCTGAAAGTGAAAGAGGAATACGAGAAGGTCGAGAAAGAGTACAAGACCCTGGAAGAGAGGATCAAAGAGGACAT |
| CCAGGCTCTGAAGGCTCTGGAACAGTATGAGAAAGAGCGGCAAGAACAGCTGCTGCGGGACACCCTGAACACCAAC |
| GAGTACCGGCTGAGCAAGAGAGGCCTTAGAGGCTGGCGGGAAATCATCCAGAAATGGCTGAAAATGGACGAGAACG |
| AGCCCTCCGAGAAGTACCTGGAAGTGTTCAAGGACTACCAGCGGAAGCACCCTAGAGAGGCCGGCGATTACAGCGT |
| GTACGAGTTCCTGTCCAAGAAAGAGAACCACTTCATCTGGCGGAATCACCCTGAGTACCCCTACCTGTACGCCACC |
| TTCTGCGAGATCGACAAGAAAAAGAAGGACGCCAAGCAGCAGGCCACCTTCACACTGGCCGATCCTATCAATCACC |
| CTCTGTGGGTCCGATTCGAGGAAAGAAGCGGCAGCAACCTGAACAAGTACAGAATCCTGACCGAGCAGCTGCACAC |
| CGAGAAGCTGAAGAAAAAGCTGACAGTGCAGCTGGACCGGCTGATCTACCCTACAGAATCTGGCGGCTGGGAAGAG |
| AAGGGCAAAGTGGACATTGTGCTGCTGCCCAGCCGGCAGTTCTACAACCAGATCTTCCTGGACATCGAGGAAAAGG |
| GCAAGCACGCCTTCACCTACAAGGATGAGAGCATCAAGTTCCCTCTGAAGGGCACACTCGGCGGAGCCAGAGTGCA |
| GTTCGACAGAGATCACCTGAGAAGATACCCTCACAAGGTGGAAAGCGGCAACGTGGGCAGAATCTACTTCAACATG |
| ACCGTGAACATCGAGCCTACAGAGTCCCCAGTGTCCAAGTCTCTGAAGATCCACCGGGACGACTTCCCCAAGGTGG |
| TCAACTTCAAGCCCAAAGAACTGACCGAGTGGATCAAGGACAGCAAGGGCAAGAAACTGAAGTCCGGCATCGAGTC |
| CCTGGAAATCGGCCTGAGAGTGATGAGCATCGACCTGGGACAGAGACAGGCCGCTGCCGCCTCTATTTTCGAGGTG |
| GTGGATCAGAAGCCCGACATCGAAGGCAAGCTGTTTTTCCCAATCAAGGGCACCGAGCTGTATGCCGTGCACAGAG |
| CCAGCTTCAACATCAAGCTGCCCGGCGAGACACTGGTCAAGAGCAGAGAAGTGCTGCGGAAGGCCAGAGAGGACAA |
| TCTGAAACTGATGAACCAGAAGCTCAACTTCCTGCGGAACGTGCTGCACTTCCAGCAGTTCGAGGACATCACCGAG |
| AGAGAGAAGCGGGTCACCAAGTGGATCAGCAGACAAGAGAACAGCGACGTGCCCCTGGTGTACCAGGATGAGCTGA |
| TCCAGATCCGCGAGCTGATGTACAAGCCTTACAAGGACTGGGTCGCCTTCCTGAAGCAGCTCCACAAGAGACTGGA |
| AGTCGAGATCGGCAAAGAAGTGAAGCACTGGCGGAAGTCCCTGAGCGACGGAAGAAAGGGCCTGTACGGCATCTCC |
| CTGAAGAACATCGACGAGATCGATCGGACCCGGAAGTTCCTGCTGAGATGGTCCCTGAGGCCTACCGAACCTGGCG |
| AAGTGCGTAGACTGGAACCCGGCCAGAGATTCGCCATCGACCAGCTGAATCACCTGAACGCCCTGAAAGAAGATCG |
| GCTGAAGAAGATGGCCAACACCATCATCATGCACGCCCTGGGCTACTGCTACGACGTGCGGAAGAAGAAATGGCAG |

TABLE 29-continued

| Sequence of pZ150-pCDNA3-BhCas12b-5893R-K846R-E836K |
|---|
| GCTAAGAACCCCGCCTGCCAGATCATCCTGTTCGAGGATCTGAGCAACTACAACCCCTACAAGGAAAGGTCCCGCT |
| TCGAGAACAGCCGGCTCATGAAGTGGTCCAGACGCGAGATCCCCAGACAGGTTGCACTGCAGGGCGAGATCTATGG |
| CCTGCAAGTGGGAGAAGTGGGCGCTCAGTTCAGCAGCAGATTCCACGCCAAGACAGGCAGCCCTGGCATCAGATGT |
| CGGGTCGTGACCAAAGAGAAGCTGCAGGACAATCGGTTCTTCAAGAATCTGCAGAGAGAGGGCAGACTGACCCTGG |
| ACAAAATCGCCGTGCTGAAAGAGGGCGATCTGTACCCAGACAAAGGCGGCGAGAAGTTCATCAGCCTGAGCAAGGA |
| TCGGAAGTGCGTGACCACACACGCCGACATCAACGCCGCTCAGAACCTGCAGAAGCGGTTCTGGACAAGAACCCAC |
| GGCTTCTACAAGGTGTACTGCAAGGCCTACCAGGTGGACGGCCAGACCGTGTACATCCCTGAGAGCAAGGACCAGA |
| AGCAGAAGATCATCGAAGAGTTCGGCGAGGGCTACTTCATTCTGAAGGACGGGGTGTACGAATGGGTCAACGCCGG |
| CAAGCTGAAAATCAAGAAGGGCAGCTCCAAGCAGAGCAGCAGCGAGCTGGTGGATAGCGACATCCTGAAAGACAGC |
| TTCGACCTGGCCTCCGAGCTGAAAGGCGAAAAGCTGATGCTGTACAGGGACCCCAGCGGCAATGTGTTCCCCAGCG |
| ACAAATGGATGGCCGCTGGCGTGTTCTTCGGAAAGCTGGAACGCATCCTGATCAGCAAGCTGACCAACCAGTACTC |
| CATCAGCACCATCGAGGACGACAGCAGCAAGCAGTCTATGGGATCCAAAAGGCCGGCGGCCACGAAAAAGGCCGGC |
| CAGGCAAAAAAGAAAAAGggatctTACCCATACGATGTTCCAGATTACGCTTATCCCTACGACGTGCCTGATTATG |
| CATACCCATATGATGTCCCCGACTATGCCtaaGAATTCTGCAGATATCCAGCACAGTGGCGGCCGCTCGAGTCTAG |
| AGGGCCCGTTTAAACCCGCTGATCAGCCTCGACTGTGCCTTCTAGTTGCCAGCCATCTGTTGTTTGCCCCTCCCCC |
| GTGCCTTCCTTGACCCTGGAAGGTGCCACTCCCACTGTCCTTTCCTAATAAAATGAGGAAATTGCATCGCATTGTC |
| TGAGTAGGTGTCATTCTATTCTGGGGGGTGGGGTGGGGCAGGACAGCAAGGGGGAGGATTGGGAAGACAATAGCAG |
| GCATGCTGGGGATGCGGTGGGCTCTATGGCTTCTGAGGCGGAAAGAACCAGCTGGGGCTCTAGGGGGTATCCCCAC |
| GCGCCCTGTAGCGGCGCATTAAGCGCGGCGGGTGTGGTGGTTACGCGCAGCGTGACCGCTACACTTGCCAGCGCCC |
| TAGCGCCCGCTCCTTTCGCTTTCTTCCCTTCCTTTCTCGCCACGTTCGCCGGCTTTCCCCGTCAAGCTCTAAATCG |
| GGGGCTCCCTTTAGGGTTCCGATTTAGTGCTTTACGGCACCTCGACCCCAAAAAACTTGATTAGGGTGATGGTTCA |
| CGTAGTGGGCCATCGCCCTGATAGACGGTTTTTCGCCCTTTGACGTTGGAGTCCACGTTCTTTAATAGTGGACTCT |
| TGTTCCAAACTGGAACAACACTCAACCCTATCTCGGTCTATTCTTTTGATTTATAAGGGATTTTGCCGATTTCGGC |
| CTATTGGTTAAAAAATGAGCTGATTTAACAAAAATTTAACGCGAATTAATTCTGTGGAATGTGTGTCAGTTAGGGT |
| GTGGAAAGTCCCCAGGCTCCCCAGCAGGCAGAAGTATGCAAAGCATGCATCTCAATTAGTCAGCAACCAGGTGTGG |
| AAAGTCCCCAGGCTCCCCAGCAGGCAGAAGTATGCAAAGCATGCATCTCAATTAGTCAGCAACCATAGTCCCGCCC |
| CTAACTCCGCCCATCCCGCCCCTAACTCCGCCCAGTTCCGCCCATTCTCCGCCCCATGGCTGACTAATTTTTTTTA |
| TTTATGCAGAGGCCGAGGCCGCCTCTGCCTCTGAGCTATTCCAGAAGTAGTGAGGAGGCTTTTTTGGAGGCCTAGG |
| CTTTTGCAAAAAGCTCCCGGGAGCTTGTATATCCATTTTCGGATCTGATCAAGAGACAGGATGAGGATCGTTTCGC |
| ATGATTGAACAAGATGGATTGCACGCAGGTTCTCCGGCCGCTTGGGTGGAGAGGCTATTCGGCTATGACTGGGCAC |
| AACAGACAATCGGCTGCTCTGATGCCGCCGTGTTCCGGCTGTCAGCGCAGGGGCGCCCGGTTCTTTTTGTCAAGAC |
| CGACCTGTCCGGTGCCCTGAATGAACTGCAGGACGAGGCAGCGCGGCTATCGTGGCTGGCCACGACGGGCGTTCCT |
| TGCGCAGCTGTGCTCGACGTTGTCACTGAAGCGGGAAGGGACTGGCTGCTATTGGGCGAAGTGCCGGGGCAGGATC |
| TCCTGTCATCTCACCTTGCTCCTGCCGAGAAAGTATCCATCATGGCTGATGCAATGCGGCGGCTGCATACGCTTGA |
| TCCGGCTACCTGCCCATTCGACCACCAAGCGAAACATCGCATCGAGCGAGCACGTACTCGGATGGAAGCCGGTCTT |
| GTCGATCAGGATGATCTGGACGAAGAGCATCAGGGGCTCGCGCCAGCCGAACTGTTCGCCAGGCTCAAGGCGCGCA |
| TGCCCGACGGCGAGGATCTCGTCGTGACCCATGGCGATGCCTGCTTGCCGAATATCATGGTGGAAAATGGCCGCTT |
| TTCTGGATTCATCGACTGTGGCCGGCTGGGTGTGGCGGACCGCTATCAGGACATAGCGTTGGCTACCCGTGATATT |
| GCTGAAGAGCTTGGCGGCGAATGGGCTGACCGCTTCCTCGTGCTTTACGGTATCGCCGCTCCCGATTCGCAGCGCA |

TABLE 29-continued

| Sequence of pZ150-pCDNA3-BhCas12b-5893R-K846R-E836K |
|---|
| TCGCCTTCTATCGCCTTCTTGACGAGTTCTTCTGAGCGGGACTCTGGGGTTCGAAATGACCGACCAAGCGACGCCC |
| AACCTGCCATCACGAGATTTCGATTCCACCGCCGCCTTCTATGAAAGGTTGGGCTTCGGAATCGTTTTCCGGGACG |
| CCGGCTGGATGATCCTCCAGCGCGGGGATCTCATGCTGGAGTTCTTCGCCCACCCCAACTTGTTTATTGCAGCTTA |
| TAATGGTTACAAATAAAGCAATAGCATCACAAATTTCACAAATAAAGCATTTTTTTCACTGCATTCTAGTTGTGGT |
| TTGTCCAAACTCATCAATGTATCTTATCATGTCTGTATACCGTCGACCTCTAGCTAGAGCTTGGCGTAATCATGGT |
| CATAGCTGTTTCCTGTGTGAAATTGTTATCCGCTCACAATTCCACACAACATACGAGCCGGAAGCATAAAGTGTAA |
| AGCCTGGGGTGCCTAATGAGTGAGCTAACTCACATTAATTGCGTTGCGCTCACTGCCCGCTTTCCAGTCGGGAAAC |
| CTGTCGTGCCAGCTGCATTAATGAATCGGCCAACGCGCGGGGAGAGGCGGTTTGCGTATTGGGCGCTCTTCCGCTT |
| CCTCGCTCACTGACTCGCTGCGCTCGGTCGTTCGGCTGCGGCGAGCGGTATCAGCTCACTCAAAGGCGGTAATACG |
| GTTATCCACAGAATCAGGGGATAACGCAGGAA (SEQ ID NO: 590) |

Example 18

Figure 36A:
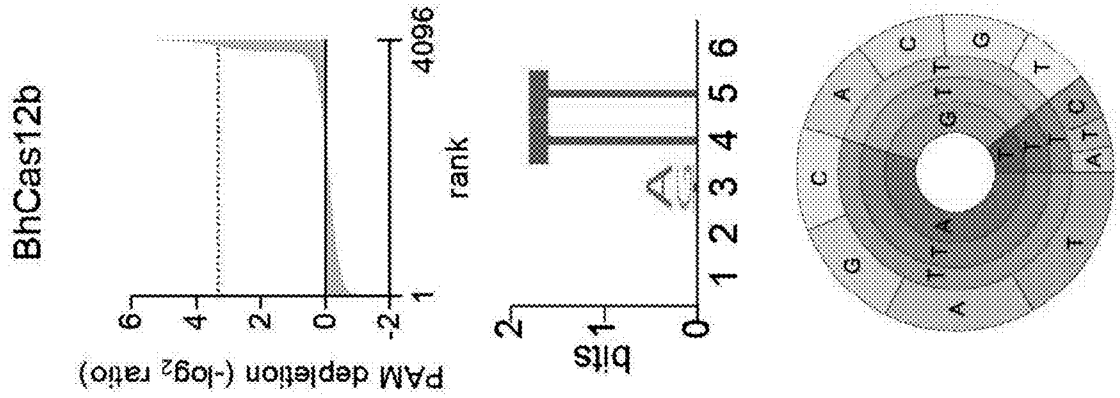
FIGS. 36A-36C shows PAM discovery results for BhCas12b under various conditions.
Figure 36B:
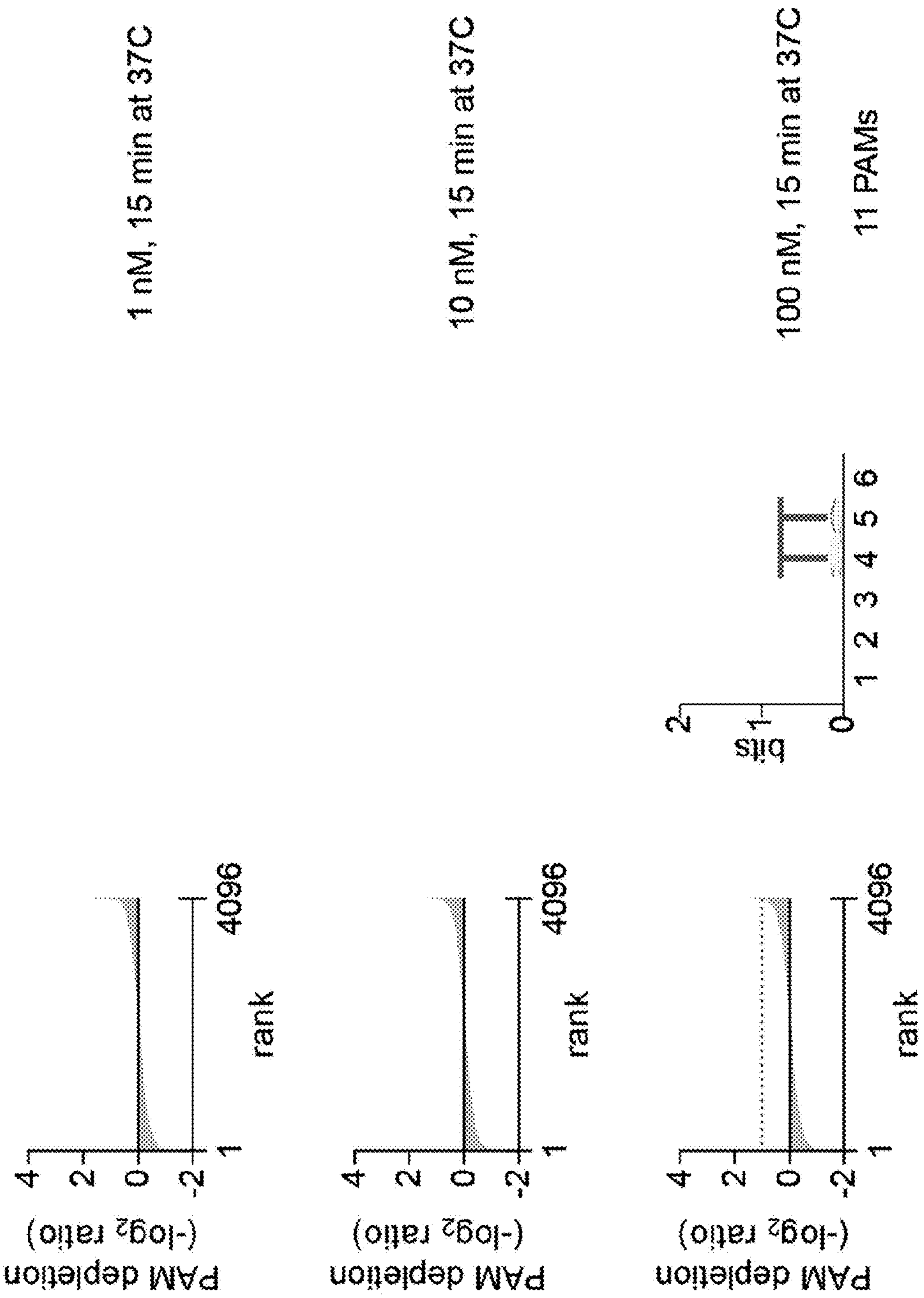
Figure 36C:
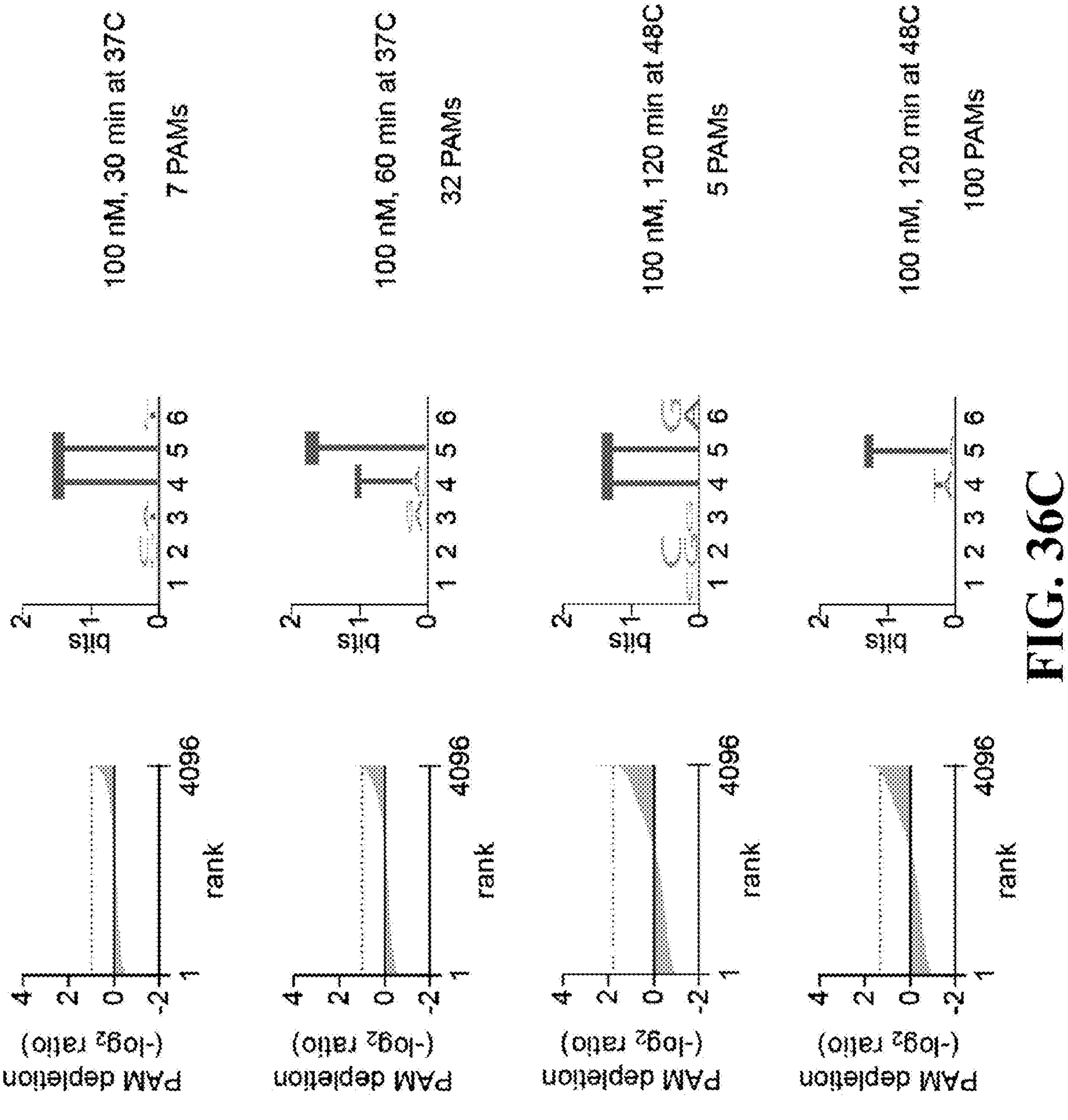

*E. coli* PAMs for BhCas2b were determined by an in vitro PAM screen under various conditions. The results are shown in FIGS. 36A-36C.

Example 19

Figure 37A:
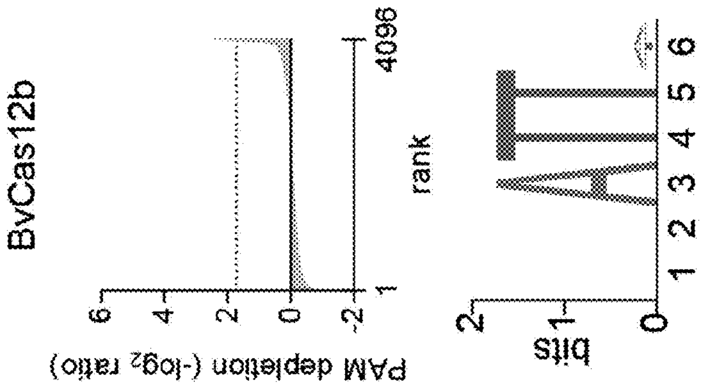
FIGS. 37A-37C shows PAM discovery results for BvCas12b under various conditions.
Figure 37B:
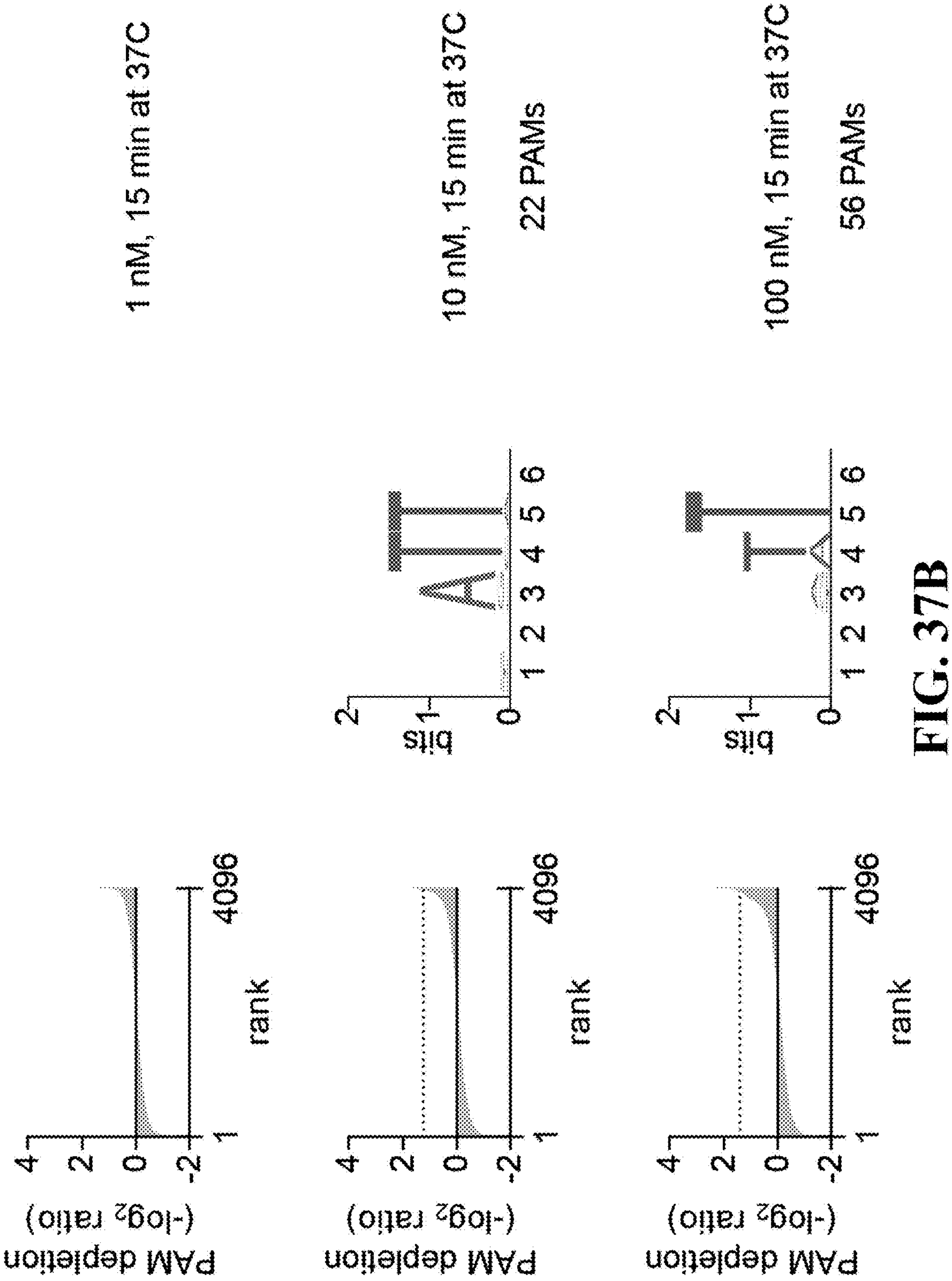
Figure 37C:
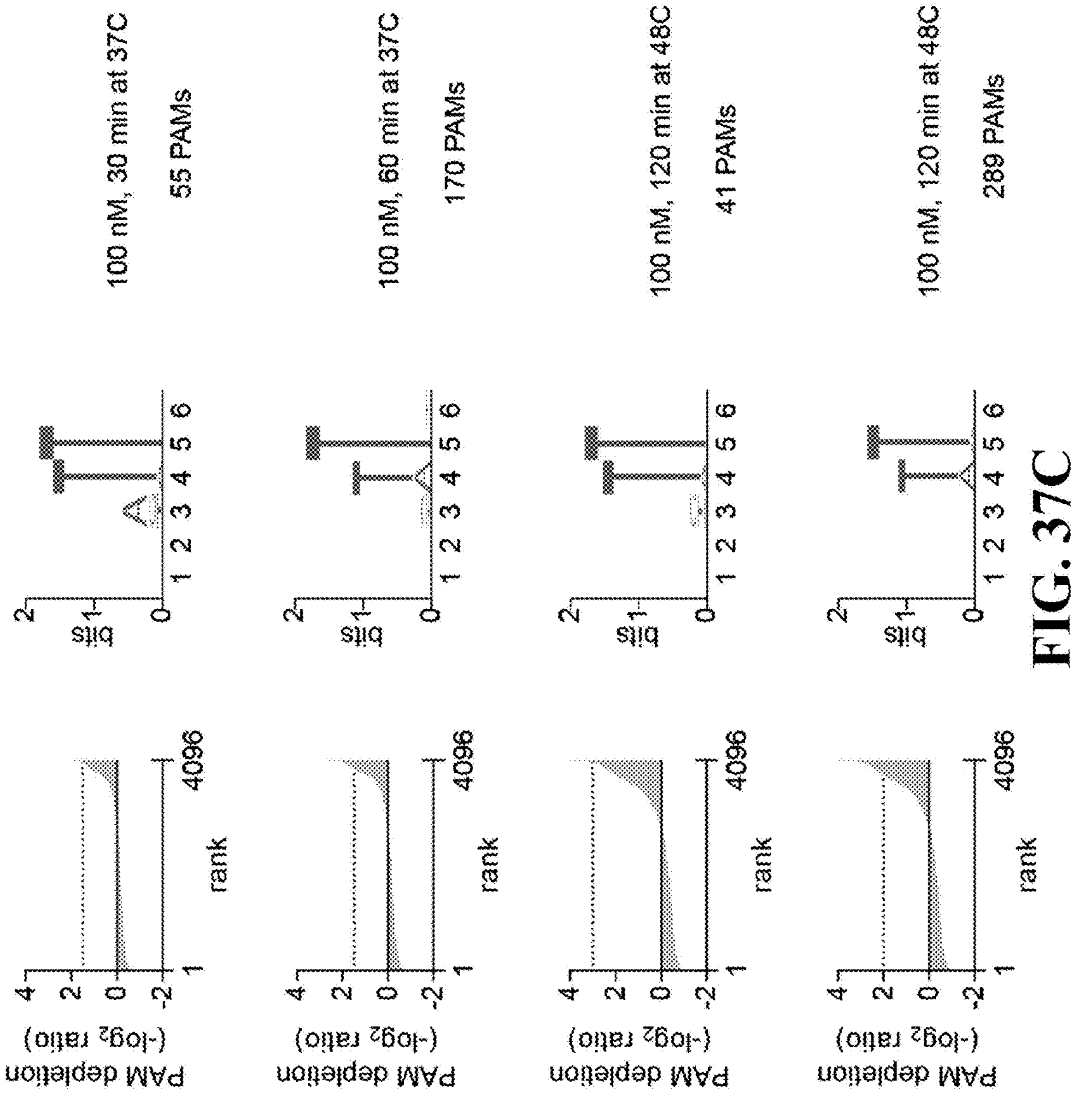

*E. coli* PAMs for BvCas2b were determined by an in vitro PAM screen under various conditions. The results are shown in FIGS. 37A-37C.

Example 20

Variants of BhCas12b were generated. The mutations are shown in Table 30 below.

TABLE 30

| BhCas12b Variants | Mutations in the variant |
|---|---|
| BhCas12b Variant 1 | S893R |
| BhCas12b Variant 2 | S893R/K846R |
| BhCas12b Variant 3 | K846R/E837G |
| BhCas12b Variant 4 | S893R/K846R/E837G |

Figure 38:
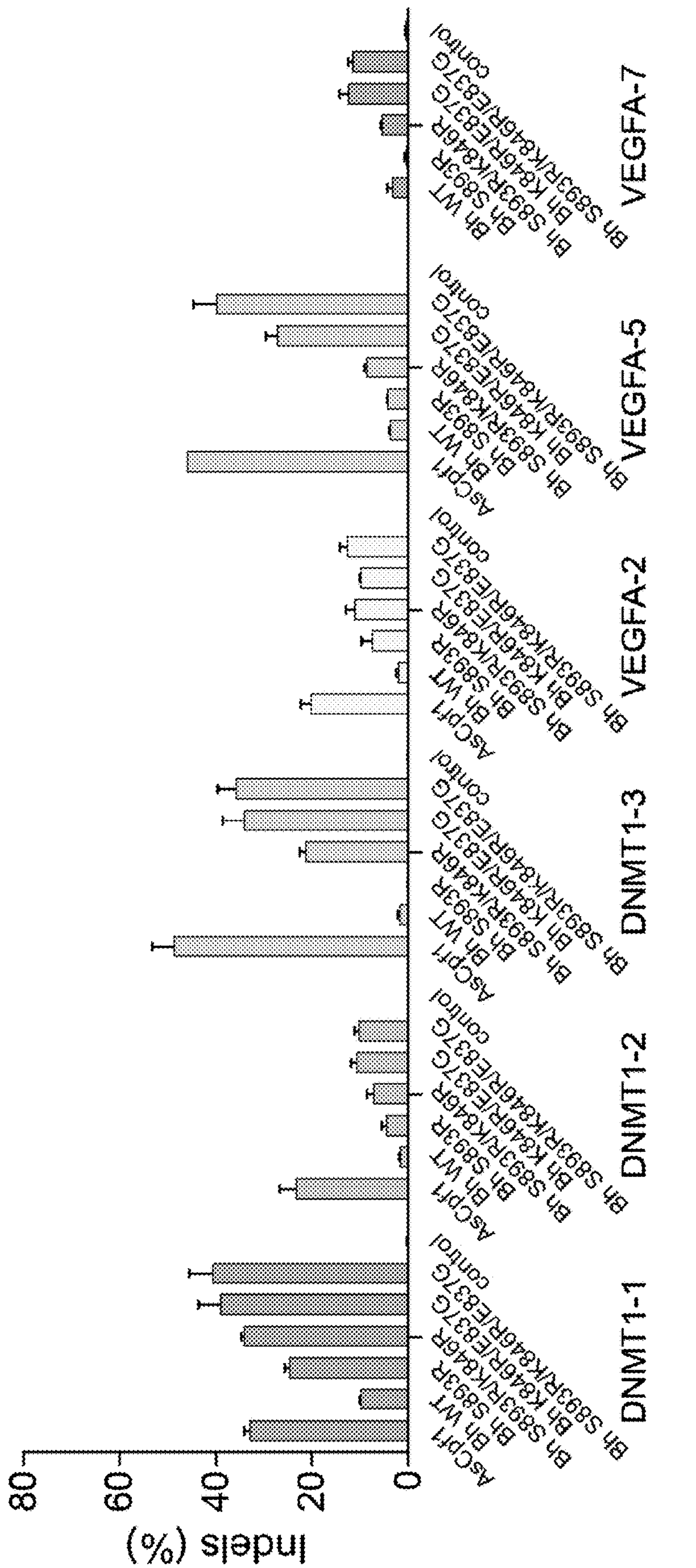
FIG. 38 shows indel percentages of BhCas12b variants at different binding sites.

Activities of the variants were evaluated by testing indel percentages at different binding sites. The results of the tests are shown in FIG. 38.

Example 21

Additional variants of BhCas12b were generated and their activities were tested and compared with the variants generated in Example 20.

Figure 39A:
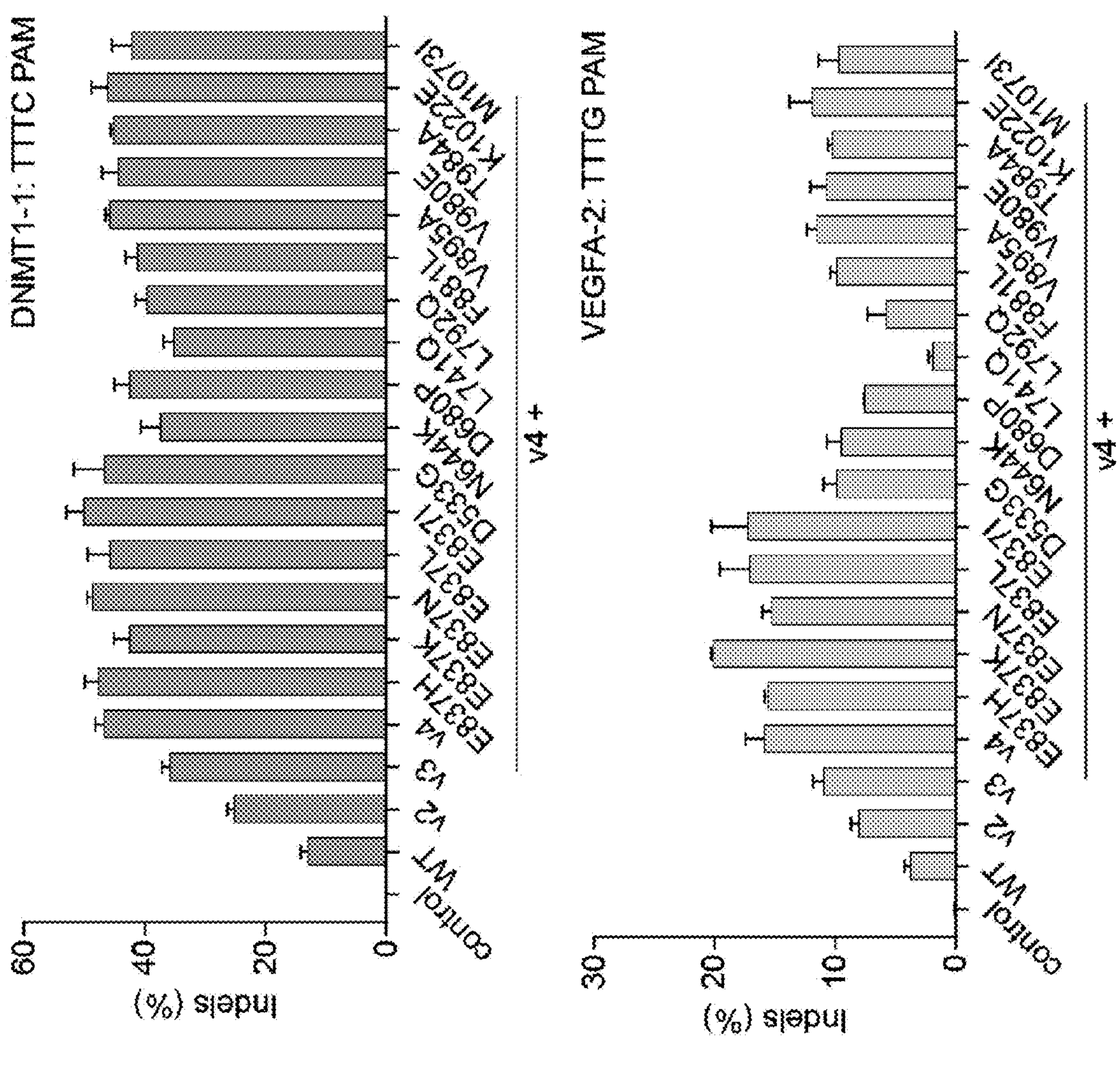
FIGS. 39A-39B shows indel percentages of additional BhCas12b variants at different binding sites.
Figure 39B:
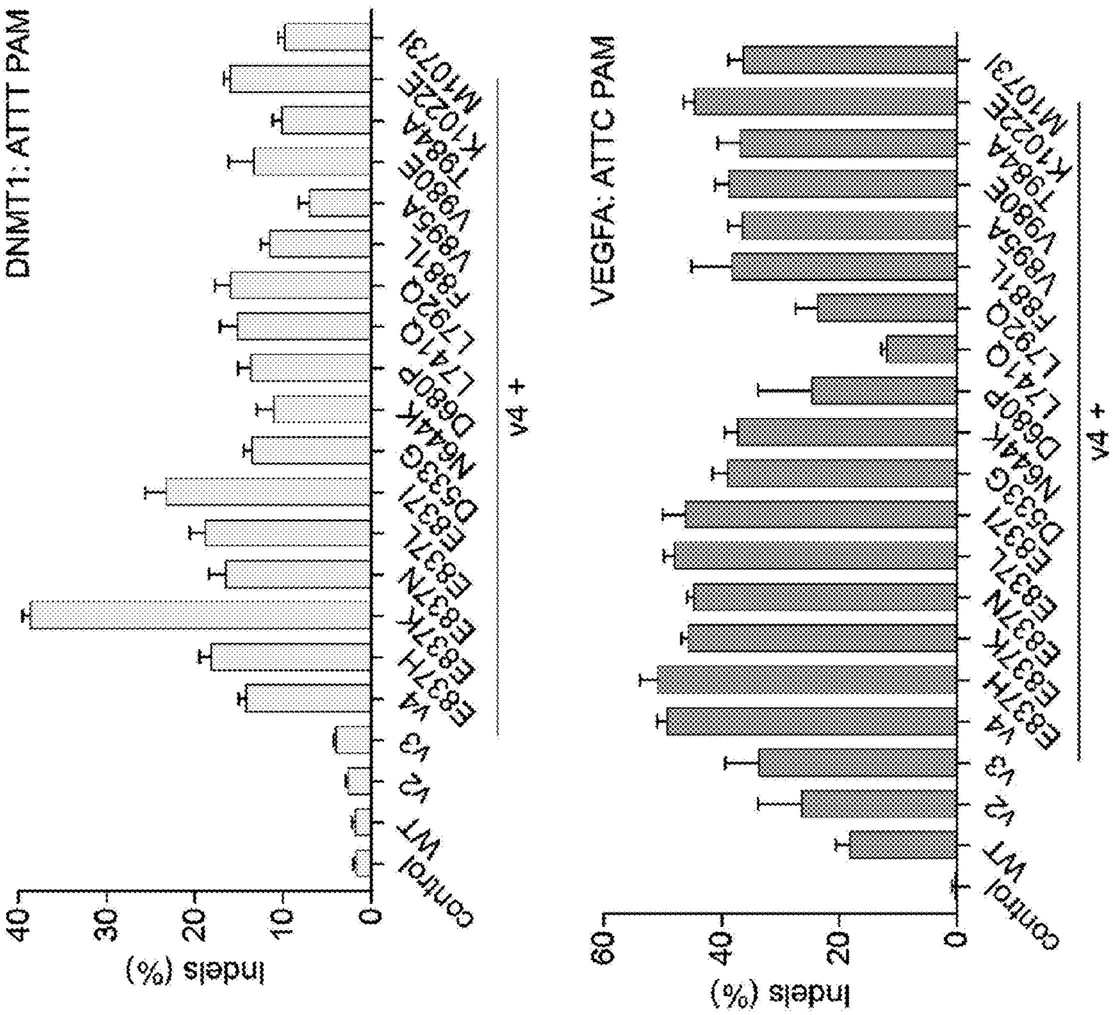

The additional variants contained mutations S893R and K846R, and further contained the mutations E837H, E837K, E837N, E837L, E8371, D533G, N644K, D680P, L741Q, L792Q, F881L, V895A, V980E, T984A, K1022E, or M1073I. Activities of the variants were evaluated by testing indel percentages at different binding sites. The results of the tests are shown in FIGS. 39A-39B.

Example 22

Figure 40A:
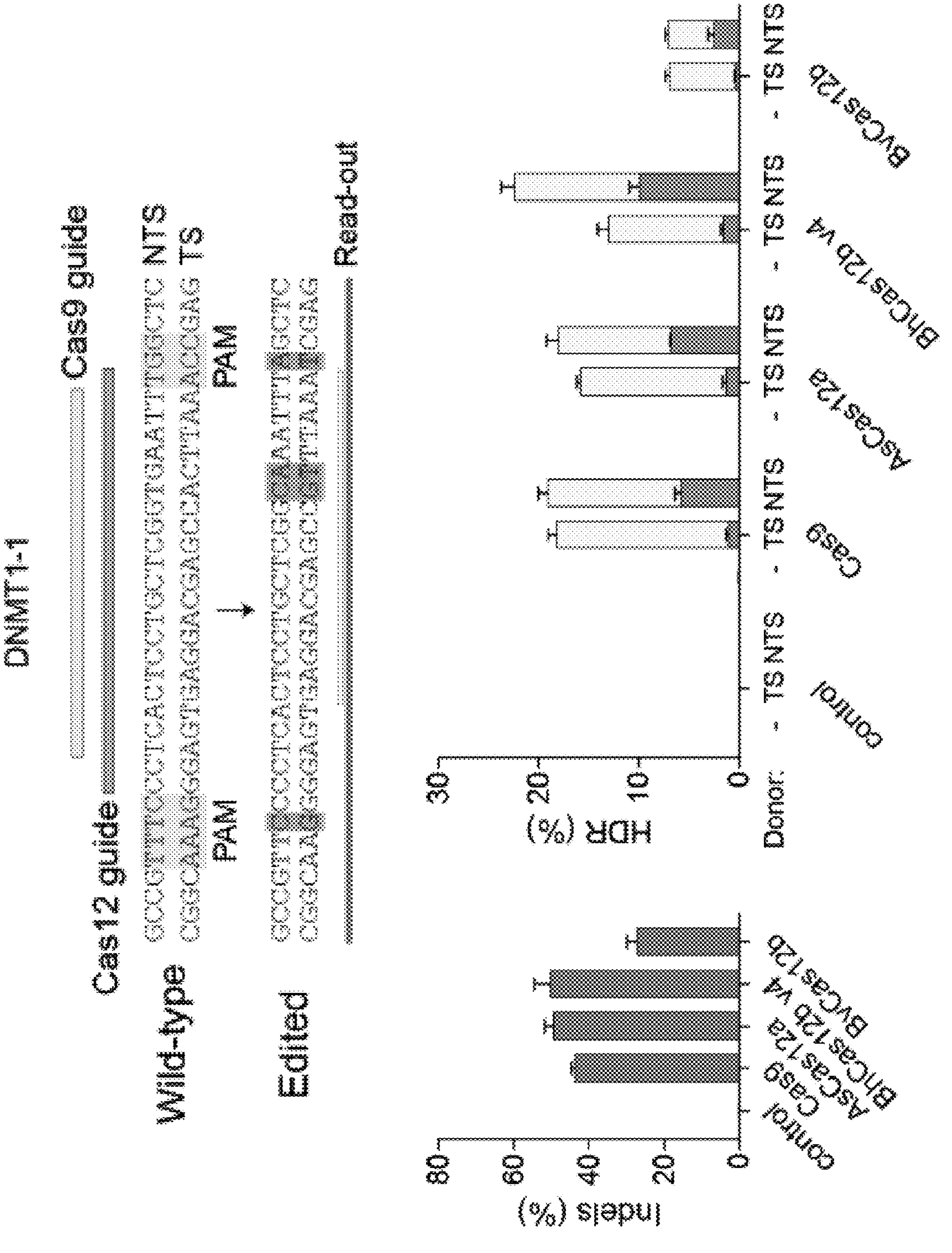
FIG. 40A shows HDR with cleavage by BhCas12b (Variant 4 in Example 20) and BvCas12b at DNMT1-1 (SEQ ID NO: 48-51).
Figure 40B:
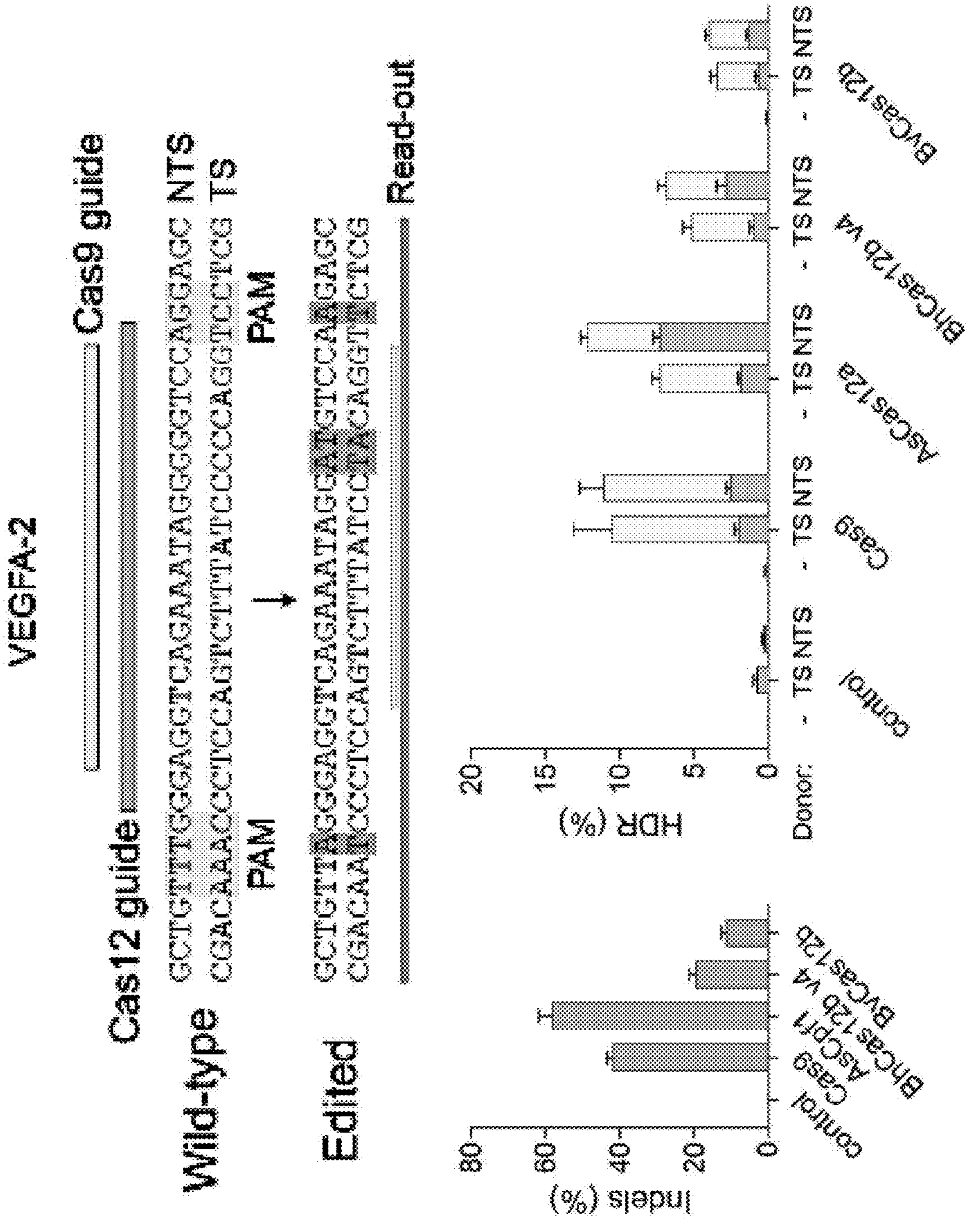
FIG. 40B shows HDR with cleavage by BhCas12b (Variant 4 in Example 20) and BvCas12bat VEGFA-2 (SEQ ID NO: 52-55).

HDR with cleavage by BhCas12b (Variant 4 in Example 20) and wildtype BvCas12b were tested at different sites. The results of HDR at DNMT1-1 are shown in FIG. 40A and HDR at VEGFA-2 are shown in FIG. 40B.

Example 23

This example shows experiments that were performed in 293T cells for testing Cas12b orthologs' activities access different PAM as well as experiments performed with ssODN donors.

Figure 41B:
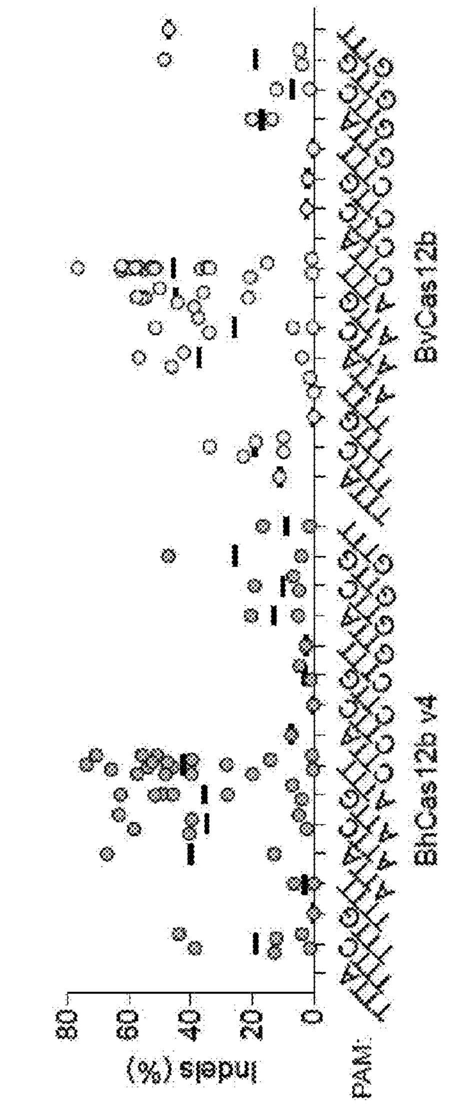
FIG. 41B shows breakdown of BhCas12b variant 4 and BvCas12b activities at different PAM sequences.
Figure 41A:
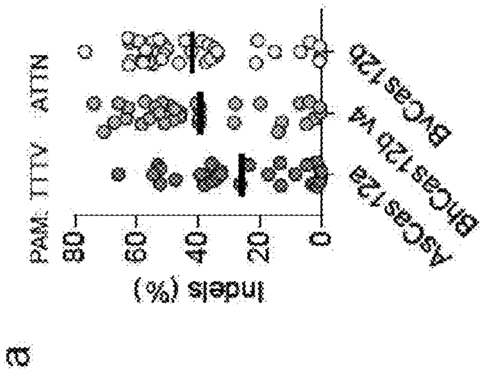
FIG. 41A shows comparison of indels percentages of AsCas12a at TTTV PAMs and BhCas12b variant 4 and BvCas12b ATTN PAMs.

FIG. 41A shows comparison of indels percentages of AsCas12a at TTTV PAMs and BhCas12b variant 4 and BvCas12b ATTN PAMS. FIG. 41B shows breakdown of BhCas12b variant 4 and BvCas12b activities at different PAM sequences.

Figure 42A:
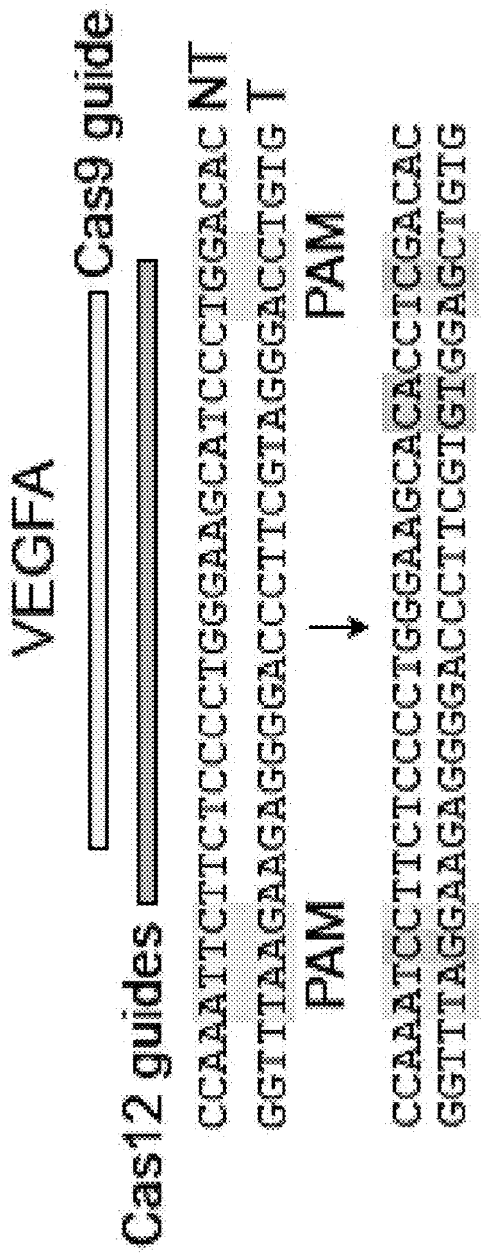
FIG. 42A shows a schematic of a VEGFA target including the desired changes to be introduced with ssDNA donors (SEQ ID NO: 56-59).
Figure 42B:
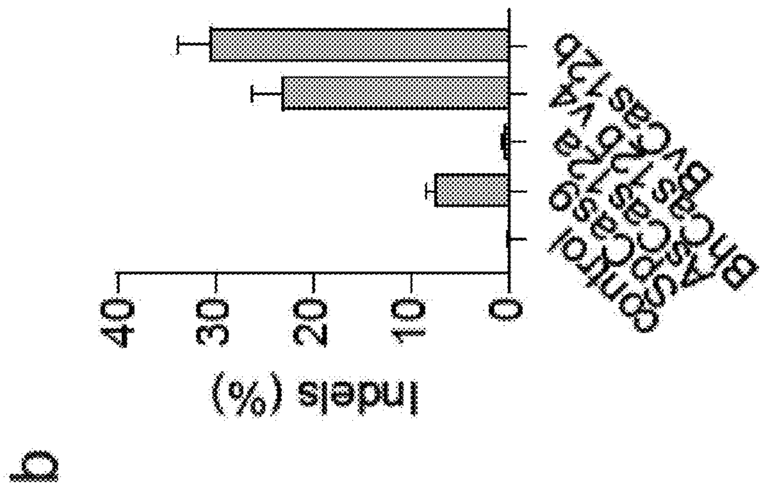
FIG. 42B shows indel activity of each nuclease at the VEGFA target site.
Figure 42C:
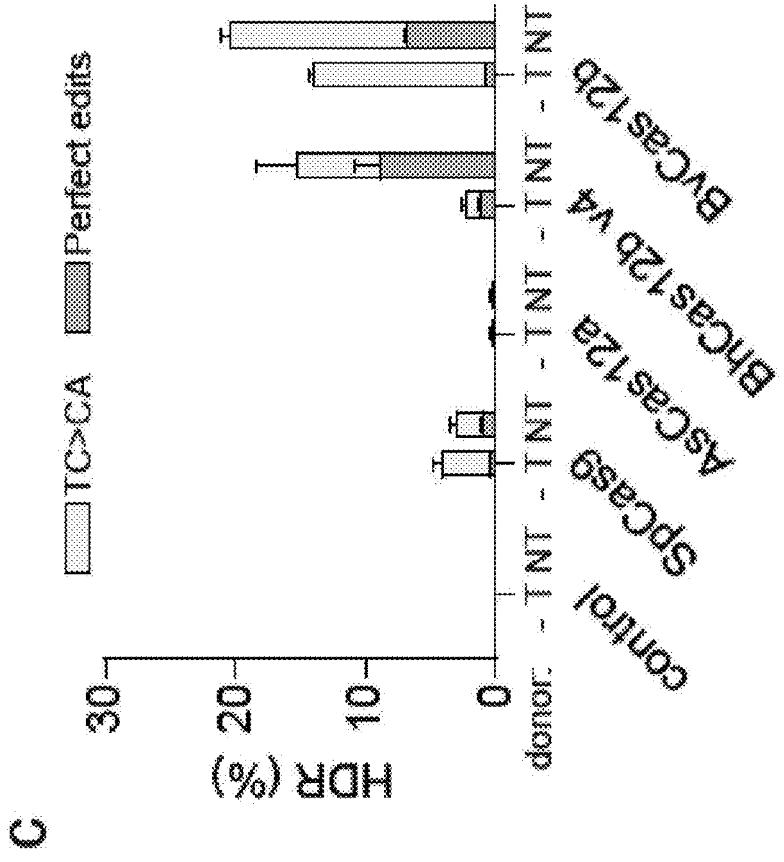
FIG. 42C shows percentages of cells that contain the desired edit (two nucleotide substitution) at the VEGFA site.
Figure 42D:
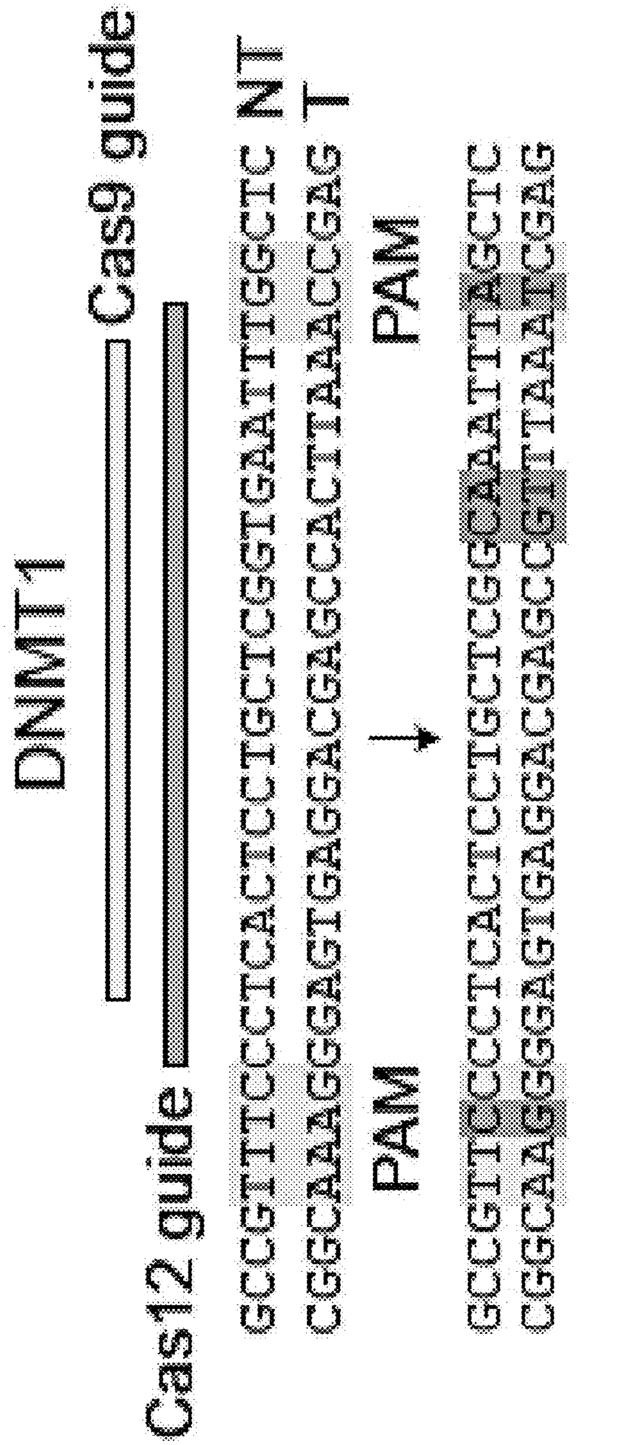
FIG. 42D shows a schematic of a DNMT1 target including the desired changes to be introduced with ssDNA donors (SEQ ID NO: 60-63).
Figure 42F:
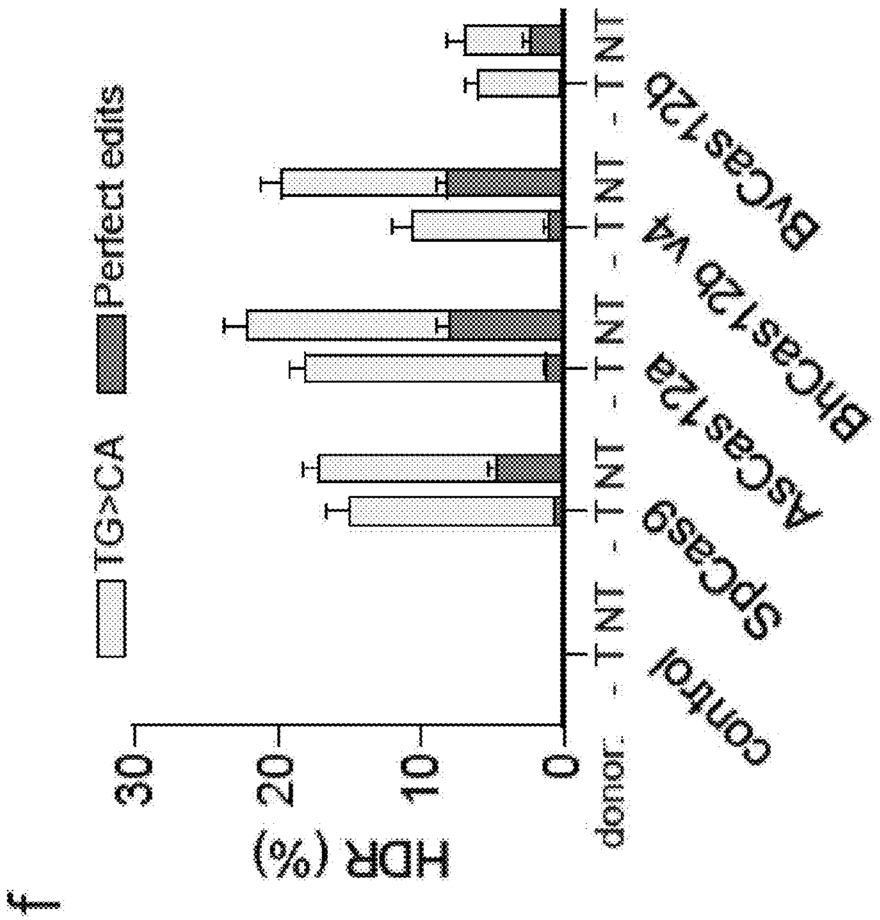
FIG. 42F shows percentages of cells that contain the desired edit (two nucleotide substitution) at the DNMT1 site.
Figure 42E:
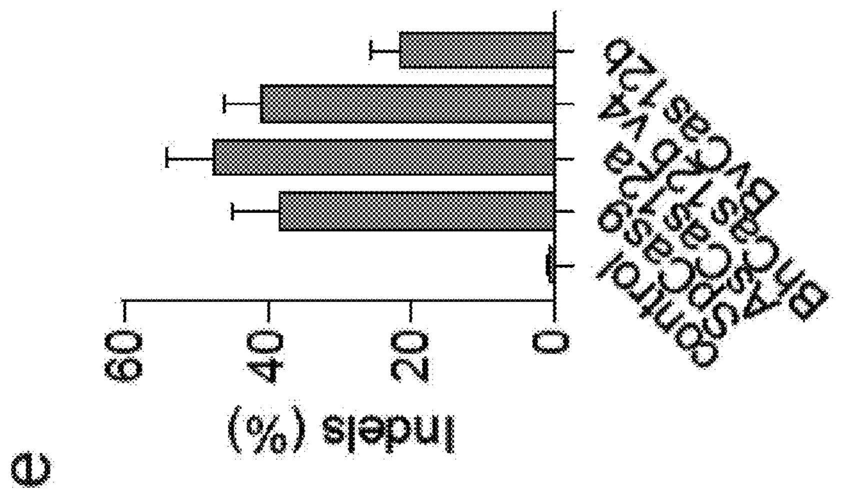
FIG. 42E shows indel activity of each nuclease at the DNMT1 target site.

FIG. 42A shows schematic of a VEGFA target including the desired changes to be introduced with ssDNA donors. FIG. 42B shows indel activity of each nuclease at the VEGFA target site. FIG. 42C shows percentage of cells that contain the desired edit (two nucleotide substitution) at VEGFA site. FIG. 42D shows Schematic of a DNMT 1 target including the desired changes to be introduced with ssDNA donors. FIG. 42E shows indel activity of each nuclease at the DNMT1 target site. FIG. 42E shows percentage of cells that contain the desired edit (two nucleotide substitution) at DNMT1site. For FIGS. 42C and 42E, Perfect edits shown in blue and red bars indicate the percentage of cells containing a perfectly corrected locus as indicated in the schematic which include the desired two nucleotide substitution, and mutation of both PAMs with no additional mutations.

Example 24

Figure 43:
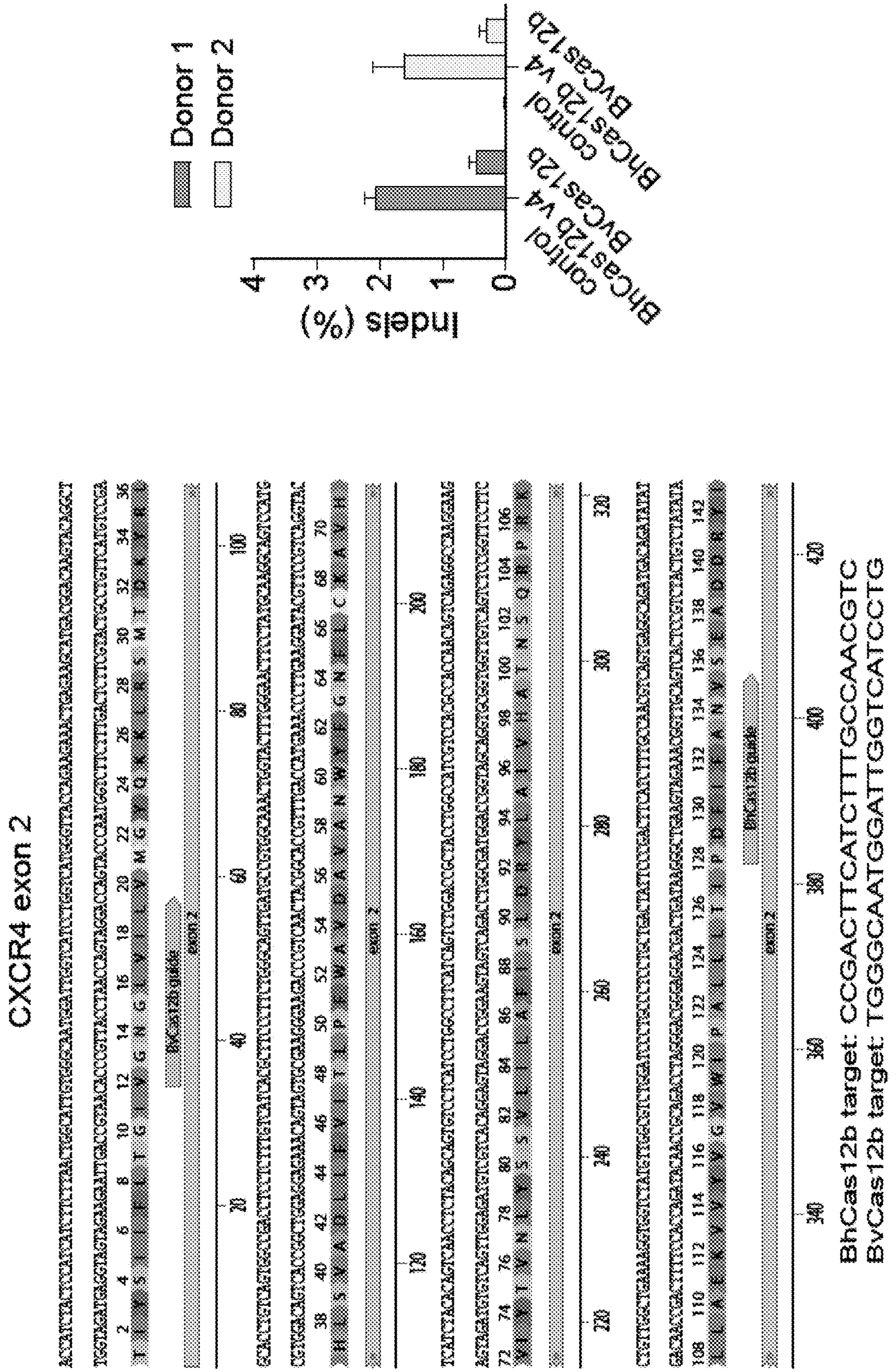
FIG. 43—Left panel shows the targeted exon of CXCR4 and the CXCR4 sequences targeted by BhCas12b (v4) and BvCas12b, respectively (SEQ ID NO: 64-77). Right panel shows indel percentages showing the effects of BhCas12b (v4) and BvCas12b on CXCR4 in the T cells from the two donors.

BhCas12b (v4) and BvCas12b ribonucleoprotein (RNP) complexes with sgRNA targeting the CXCR4 gene were assembled in vitro and electroporated into human CD4+ T cells using a Lonza 4D-Nucleofector. The human CD4+ T cells were acquired from two different donors. The RNPs were delivered at 3 μM final concentration into $3\times10^5$ cells. Electroporated cells were harvested after 48 h and indel mutations read out by targeted deep sequencing. The left panel of FIG. 43 shows the targeted exon of CXCR4 and the CXCR4 sequences targeted by BhCas12b (v4) and BvCas12b, respectively. The right panel of FIG. 43 shows indel percentages showing the effects of BhCas12b(v4) and BvCas12b on CXCR4 in the T cells from the two donors.

Example 25—Genome Editing Using CRISPR-Cas12b

The type-V CRISPR effector Cas12b (also known as C2c1) has been challenging to develop for genome editing in human cells, at least in part due to the high temperature requirement of the characterized family members. Here Applicants explored the diversity of the Cas12b family and identified an example promising candidate for human gene editing from *Bacillus hisashii*, BhCas12b. At 37° C., wild-type BhCas12b preferentially nicks the non-target DNA strand instead of forming a double strand break, leading to lower editing efficiency. Using a combination of approaches, Applicants identified gain-of-function mutations for BhCas12b that overcome this limitation. Mutant BhCas12b facilitated robust genome editing in human cell lines and ex vivo in primary human T cells, and exhibited greater specificity compared to *S. pyogenes* Cas9. This work establishes a third RNA-guided nuclease platform, in addition to Cas9 and Cpf1/Cas12a, for genome editing in human cells.

Here Applicants searched for mesophilic Cas12b enzymes and identified a promising candidate from *Bacillus hisashii*, BhCas12b, which preferentially nicks the non-target DNA strand at 37° C. Using a combination of approaches, Applicants engineered BhCas12b variants that overcome this limitation and cleave both DNA strands at 37° C. Applicants also identified a second *Bacillus* sp. ortholog sequenced from a sample isolated from the clean room where the Viking spacecrafts were assembled[2], BvCas12b, which naturally mimics the engineered BhCas12b variant. Both characterized Cas12b nucleases facilitated efficient genome-editing in human cells and exhibited a higher specificity compared to Cas9. Thus, the characterization and engineering of BhCas12b and BvCas12b provide new tools for highly-specific genome editing in human cells, unlocking the potential of this novel class of CRISPR-Cas systems.

Figure 44A:
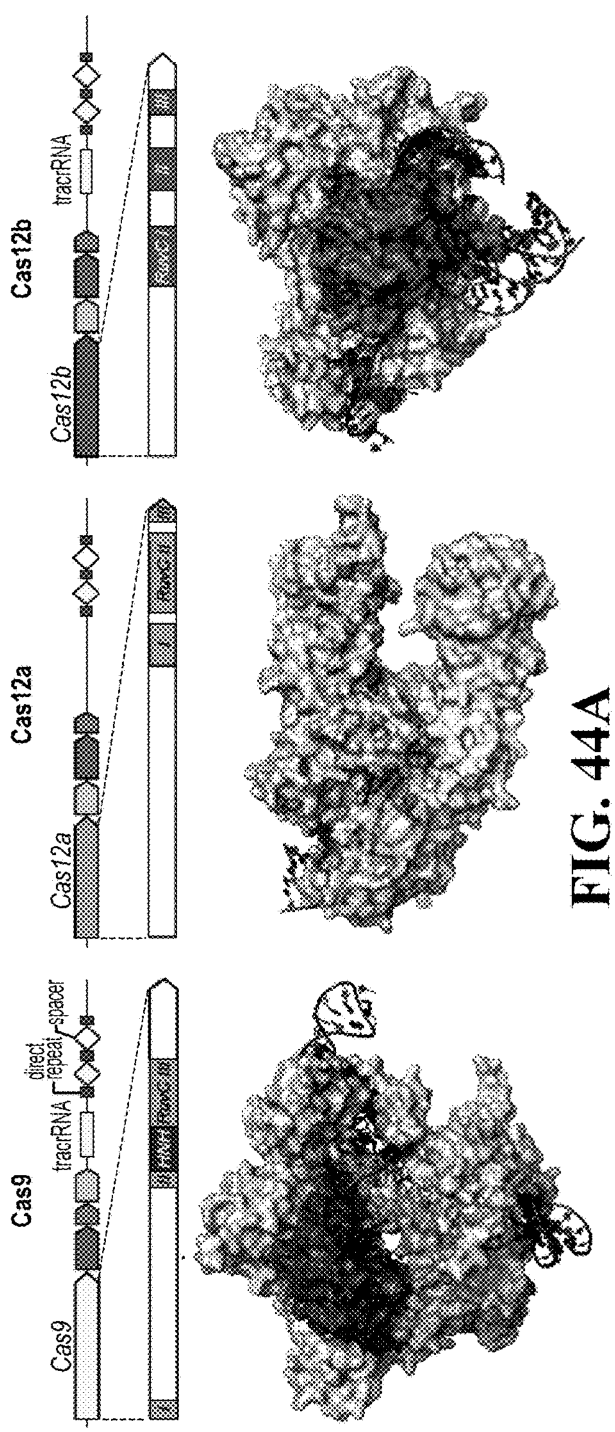
FIGS. 44A-44E. Identification of mesophilic Cas12b nucleases.

Genome editing tools may be desired to be reprogrammable and highly specific, and the prokaryotic Clustered, Regularly Interspaced Short Palindromic Repeats and CRISPR-associated proteins (CRISPR-Cas) systems are naturally endowed with these properties[3,4]. Current genome editing technology has focused on Class 2 CRISPR-Cas systems, which contain single-protein effector nucleases for genome cleavage, however, only two families of Class 2 nucleases have been harnessed for genome editing in human cells to date: Cas9[5,6], which may function with a tracrRNA[7] and contains both HNH and RuvC nuclease domains[8,9], and Cas12a[10], which uses a short crRNA and contains a single RuvC domain. Here Applicants focused on a third family of Class 2 endonuclease, Cas12b, which contains a single RuvC domain and requires a tracrRNA[11] (FIG. 44*a*). Although Cas12b proteins are often smaller than Cas9 and Cas12a and appear potentially promising for genome editing, the best characterized Cas12b nuclease from *Alicyclobacillus acidoterrestris* (AacCas12b) exhibits optimal DNA cleavage activity at 48° C.[1]. Given the diverse properties of Cas effectors within well-characterized families[10,12], Applicants sought to identify Cas12b family members that would be active at lower temperatures and thus could be adapted for human genome editing.

Figure 48A:
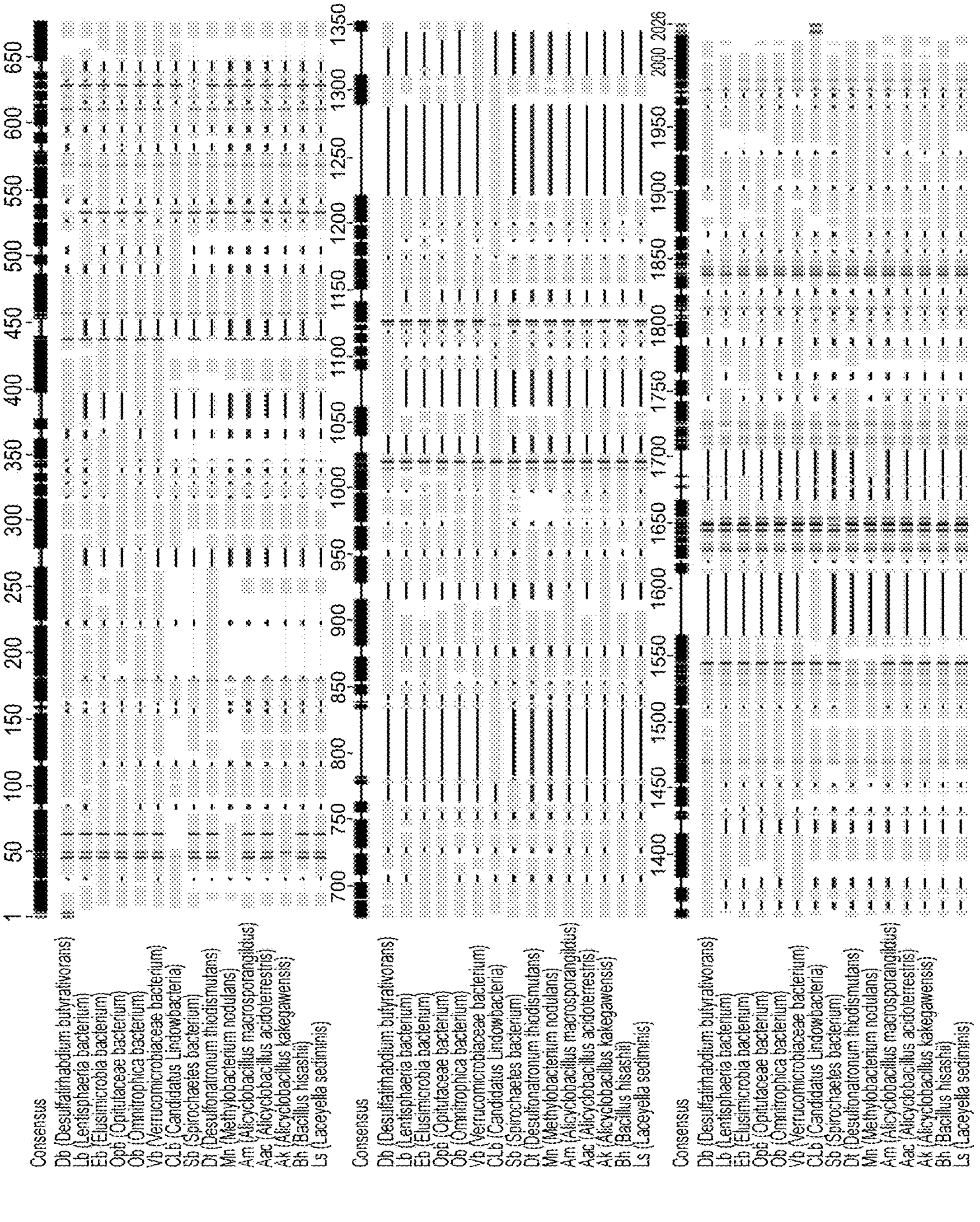
FIGS. 48A-48E PAM discovery of Cas12b orthologs.
Figure 48B:
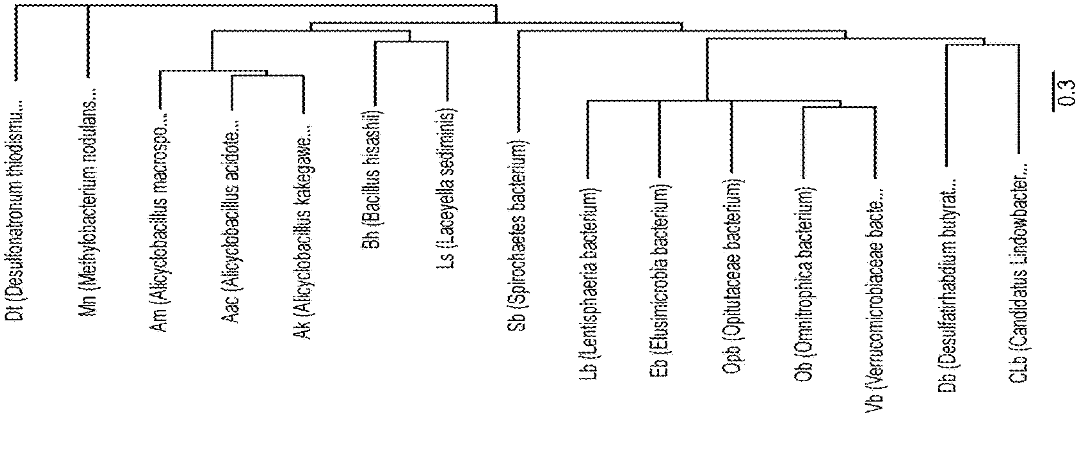
Figure 48C:
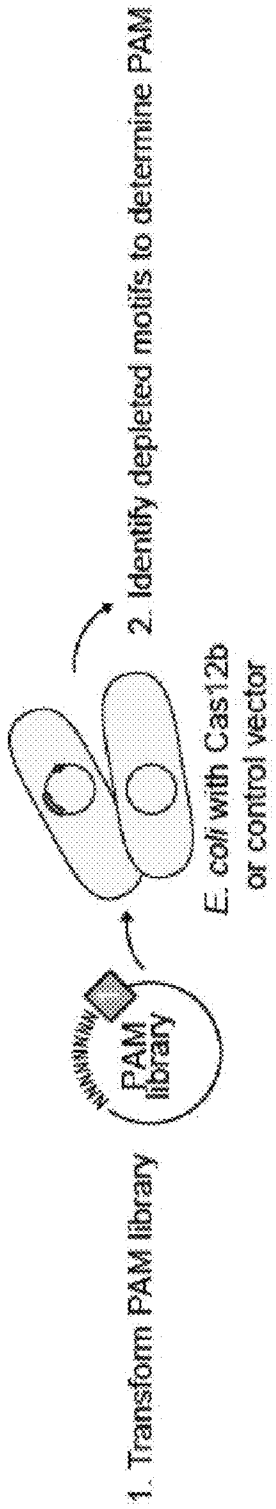
Figure 48D:
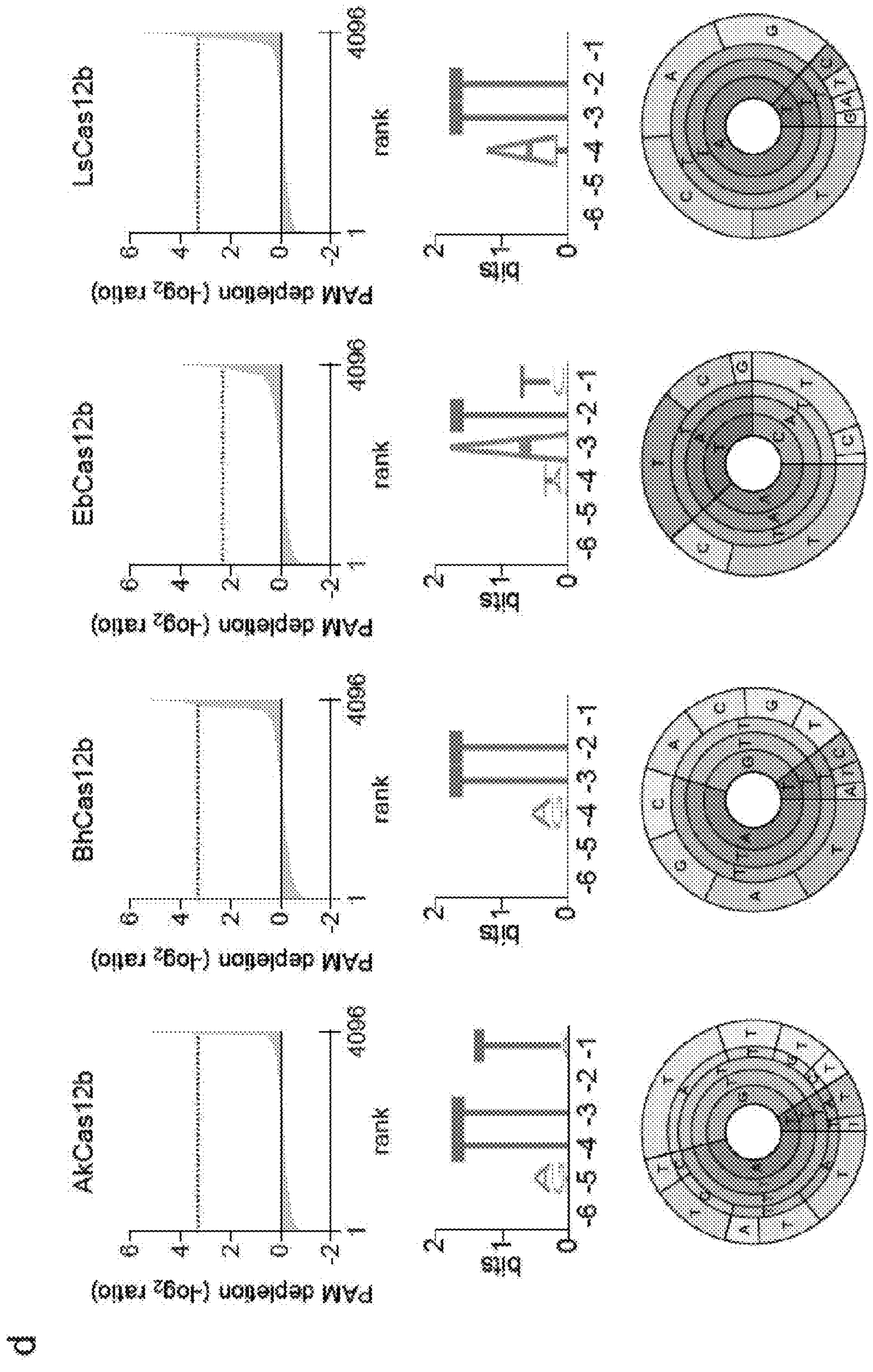
Figure 48E:
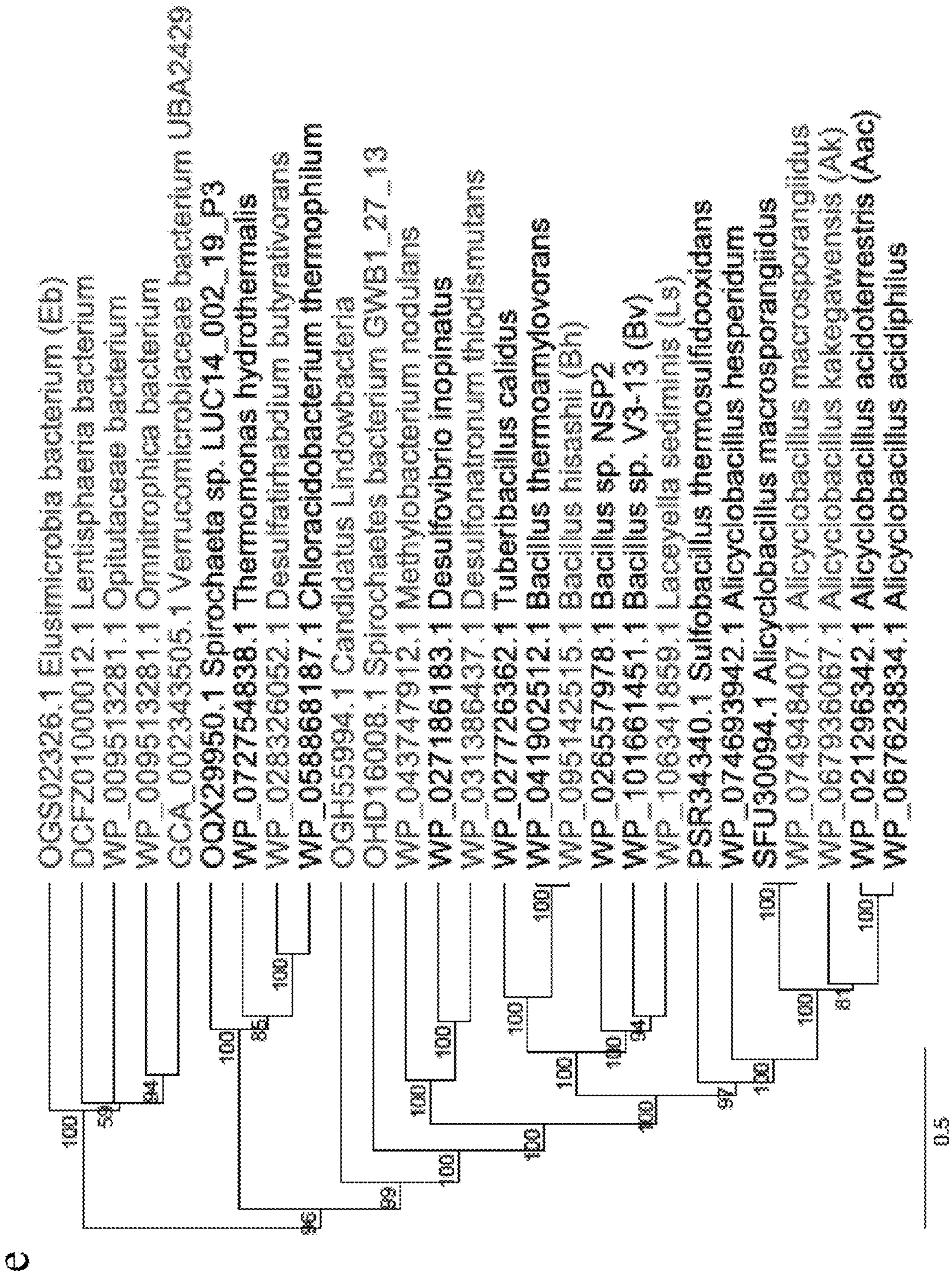

A BLAST search of the updated sequence databases using previously detected Cas12b proteins as queries identified about 25 members of the Cas12b family that are encoded within type V-B loci. The type V-B systems are widely scattered among bacteria, and topology of the phylogenetic tree of Cas12b (FIG. 48*a*) generally does not follow the bacterial taxonomy, suggestive of extensive horizontal mobility. Notably, however, about half of the type V-B loci that form a strongly supported clade in the tree are found in members of the bacterial order Bacillales. Applicants chose 14 uncharacterized Cas12b genes from diverse bacteria for experimental study (FIG. 48*e*), avoiding previously described members and those from recognized thermophiles. All known Class 2 DNA-targeting CRISPR-Cas nucleases require a protospacer-adjacent motif (PAM)[8,10] for DNA cleavage, and the initial characterization of the Cas12b family revealed a PAM on the 5' side of the target site[1]. To confirm that identified loci are functional CRISPR-Cas systems and to identify their PAMs, for each of the 14 candidates, Applicants expressed a human codon optimized Cas12b with their natural flanking sequence in *E. coli* and challenged transformed cells with a randomized 5' PAM library followed by deep sequencing (FIGS. 48*b* and 48*c*). Applicants detected depletion in 4 of the 14 tested Cas12b systems (AkCas12b, BhCas12b, EbCas12b, and LsCas12b) indicating functional DNA interference in a heterologous host. Depleted PAMs were T-rich at positions 1-4 bp upstream of the spacer, consistent with the preferences observed for previously studied Cas12b members[11]. Applicants performed small RNA-Seq on *E. coli* lysates to identify the required RNA components and found putative tracrRNAs mapping to the region between Cas12b and the CRISPR array (FIGS. 49*a*-49*d*).

Figure 44B:
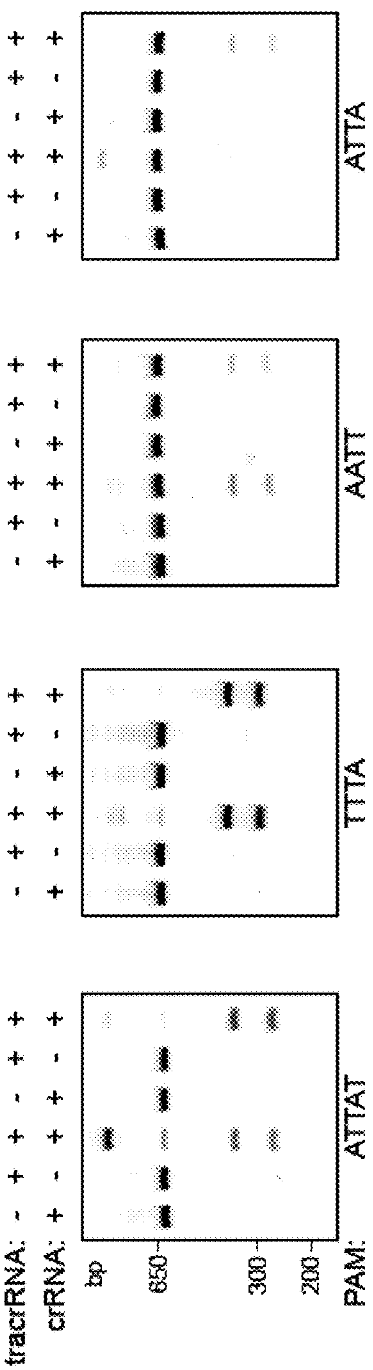
Figure 44C:
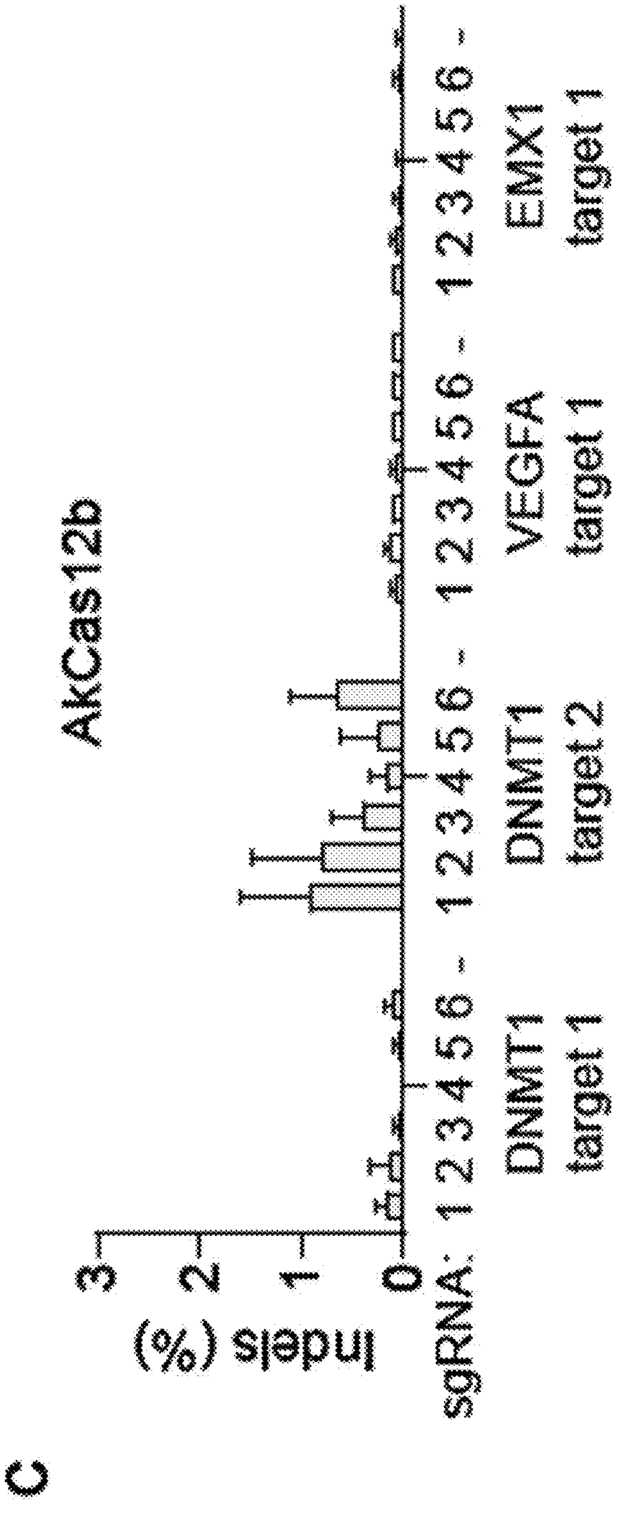
Figure 44D:
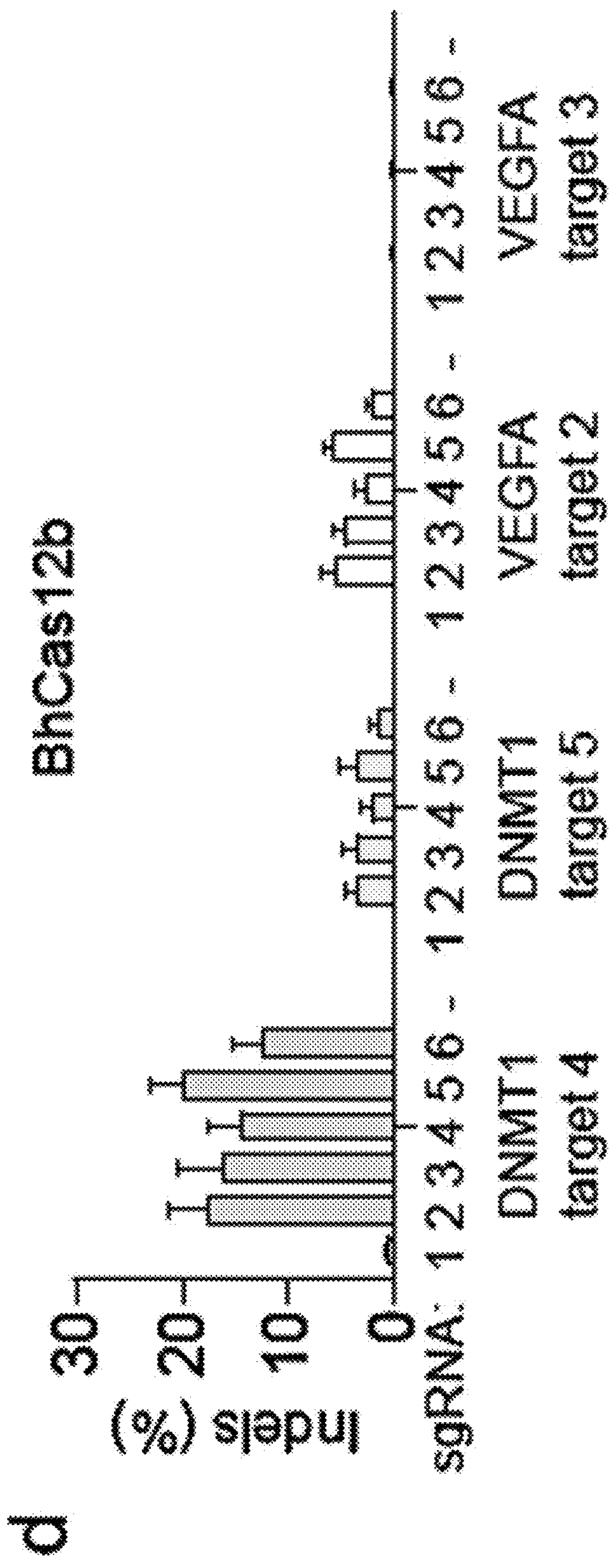
Figure 44E:
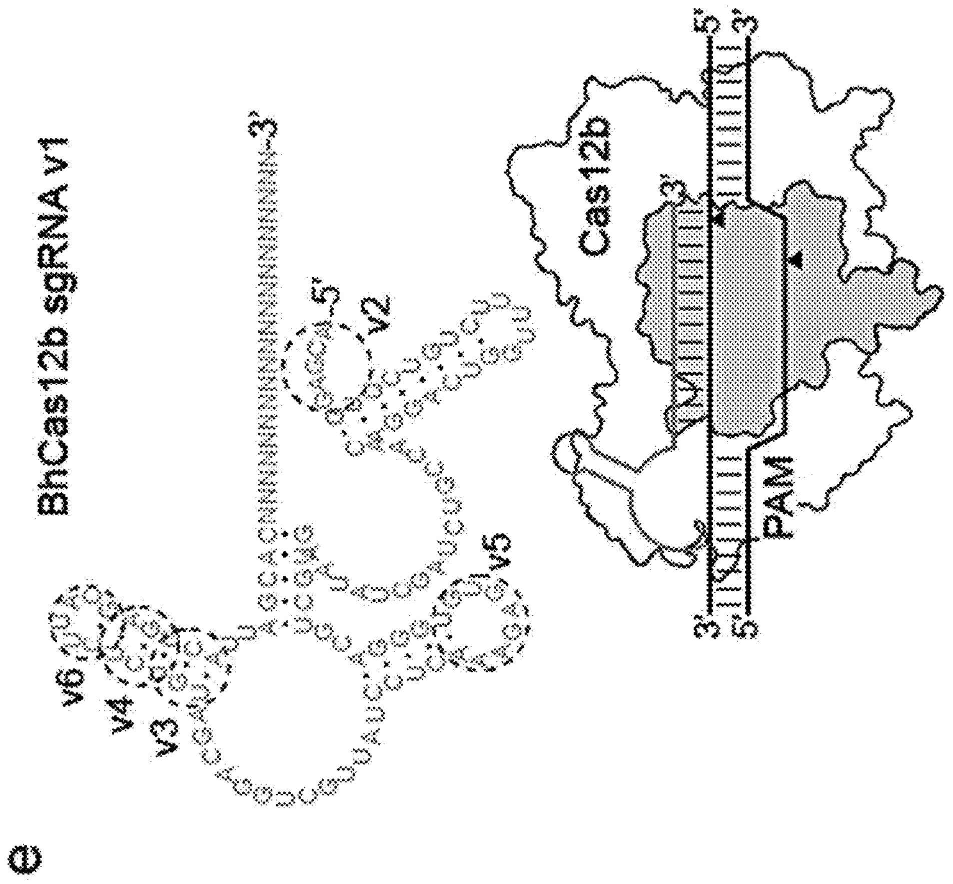
Figure 49A:
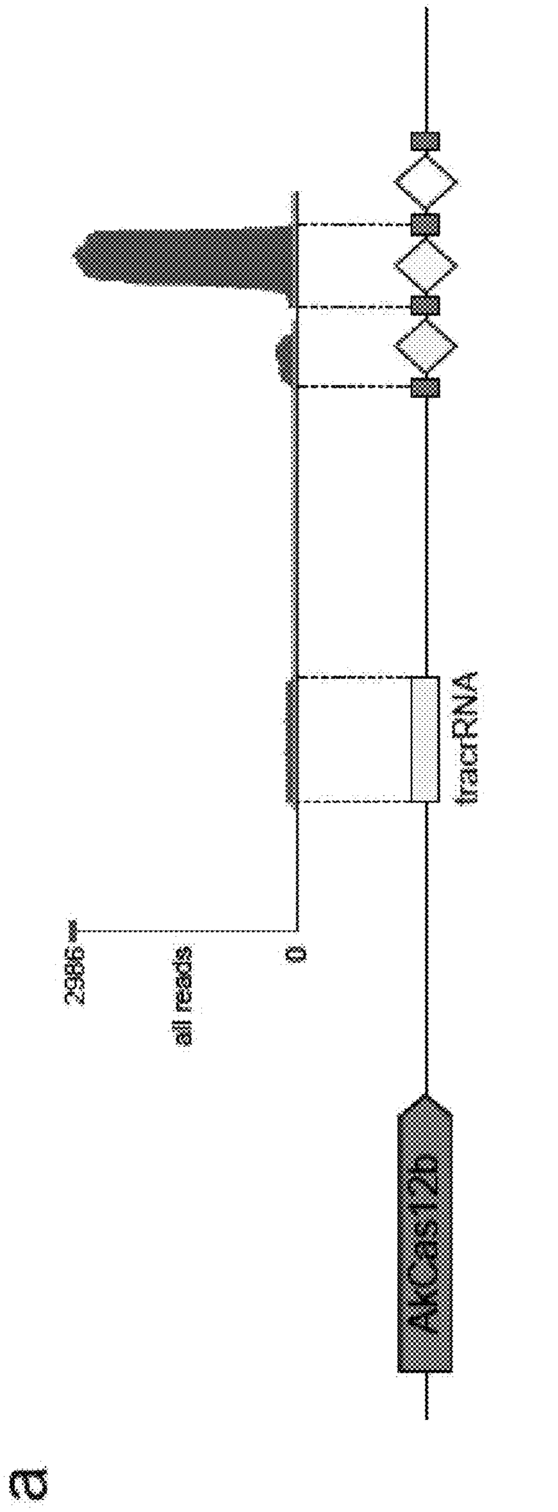
FIGS. 49A-49F. Cas12b RNA-Seq and in vitro reconstitution.
Figure 49B:
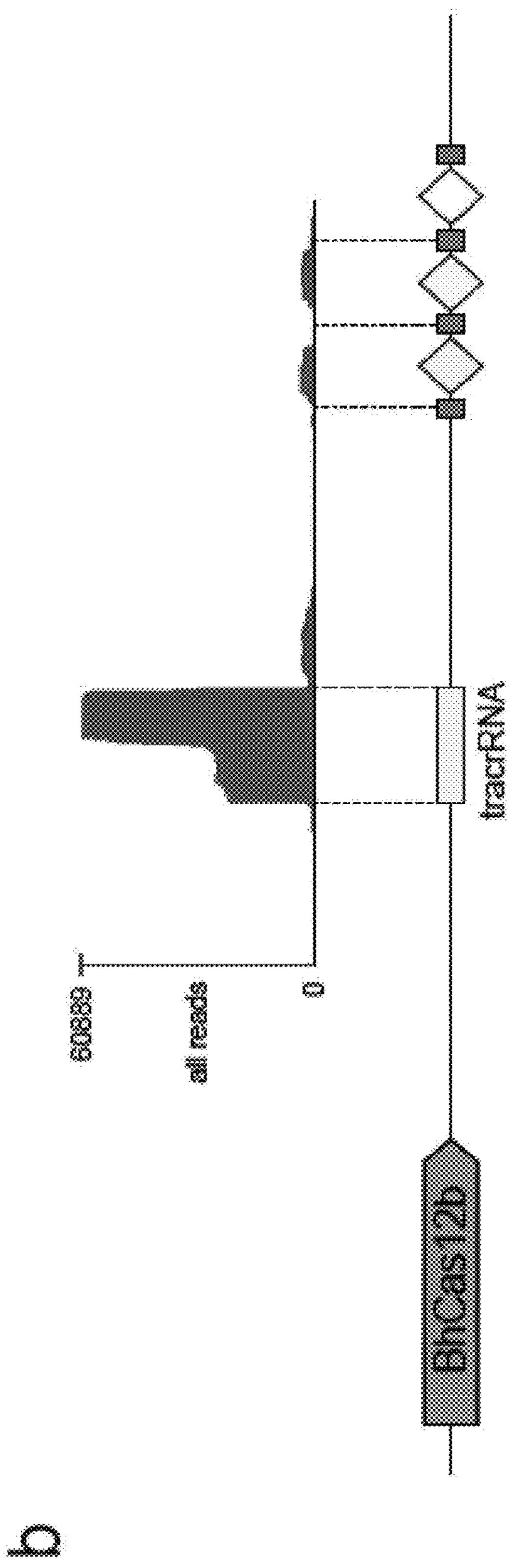
Figure 49C:
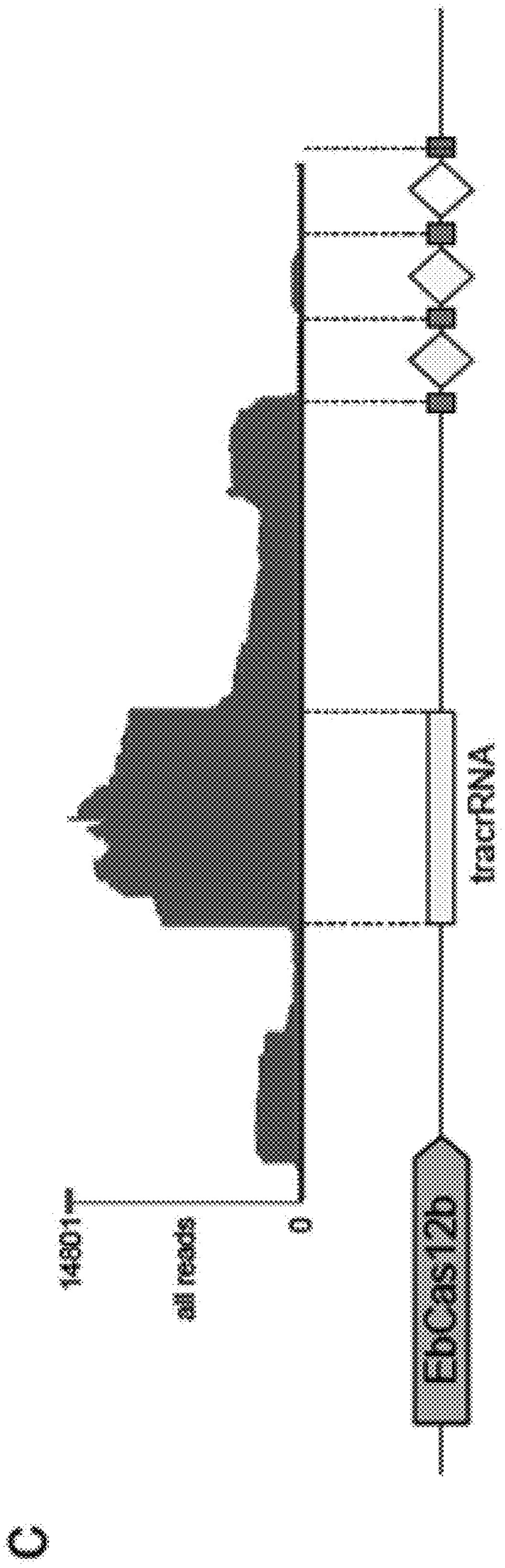
Figure 49D:
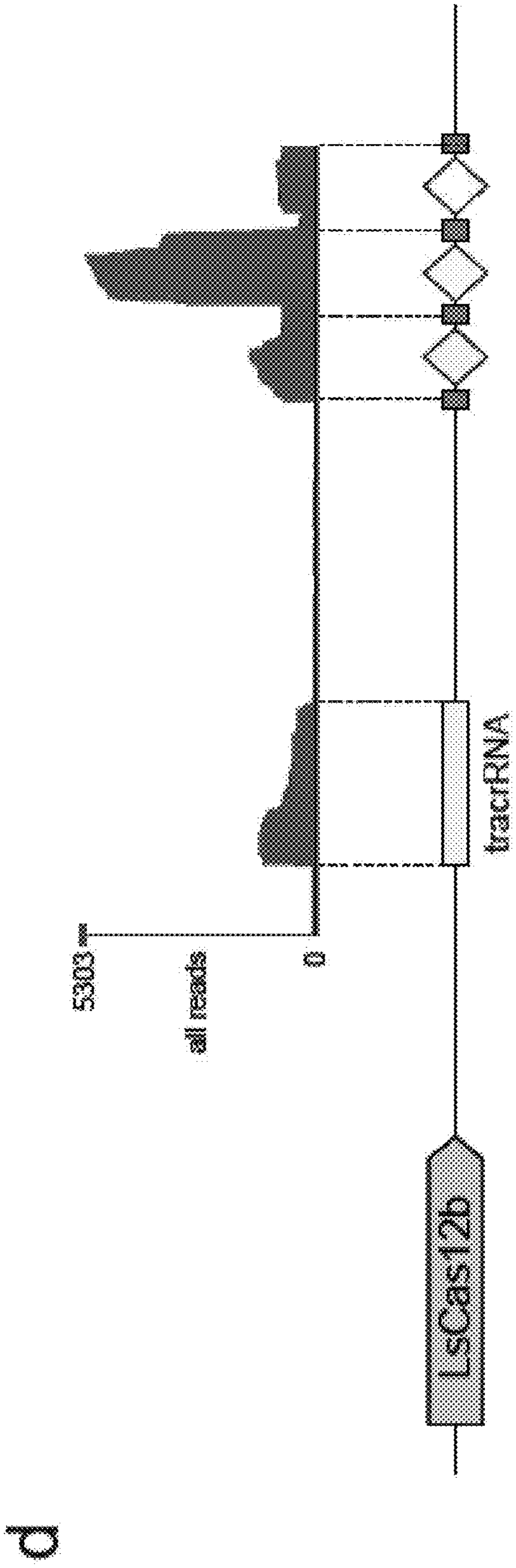
Figure 49F:
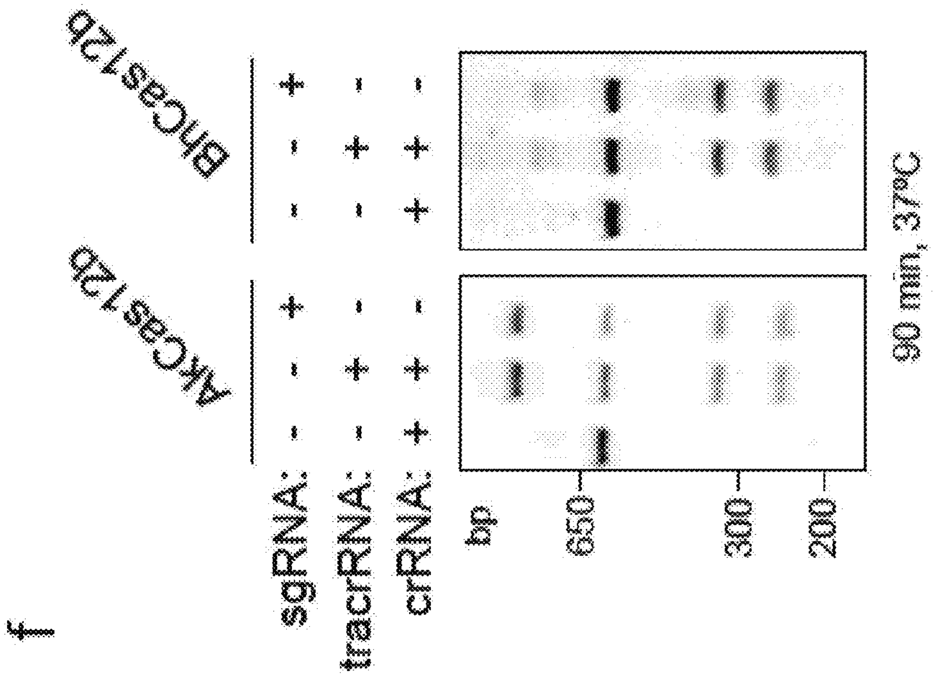
Figure 49E:
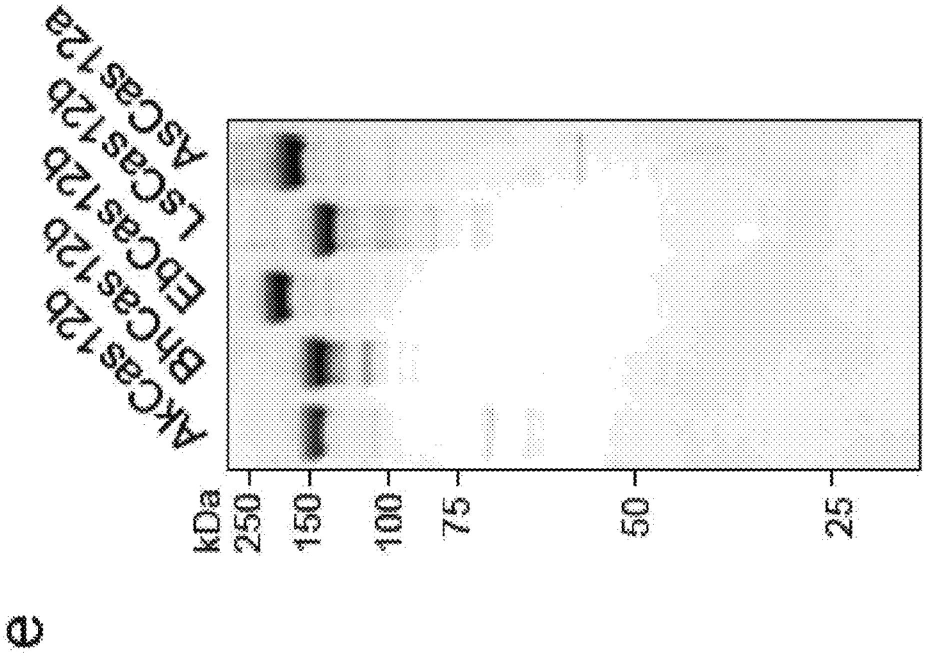
Figure 50A:
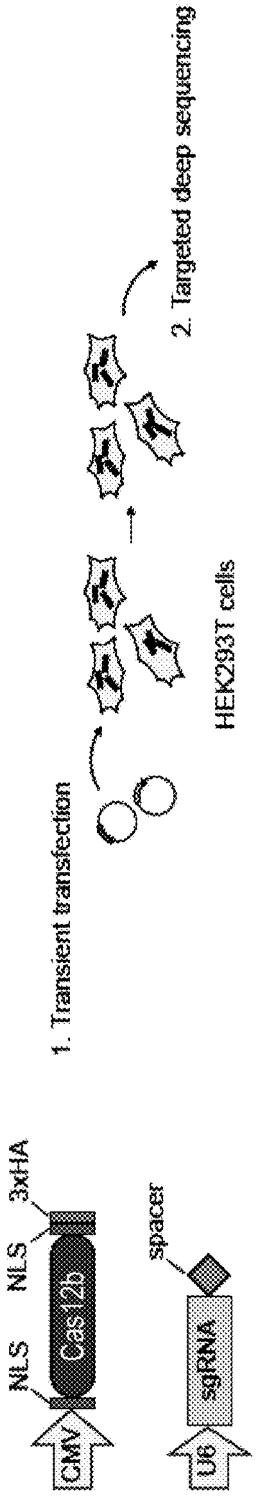
FIGS. 50A-50E. Cas12b sgRNA optimization in mammalian cells.
Figure 50B:
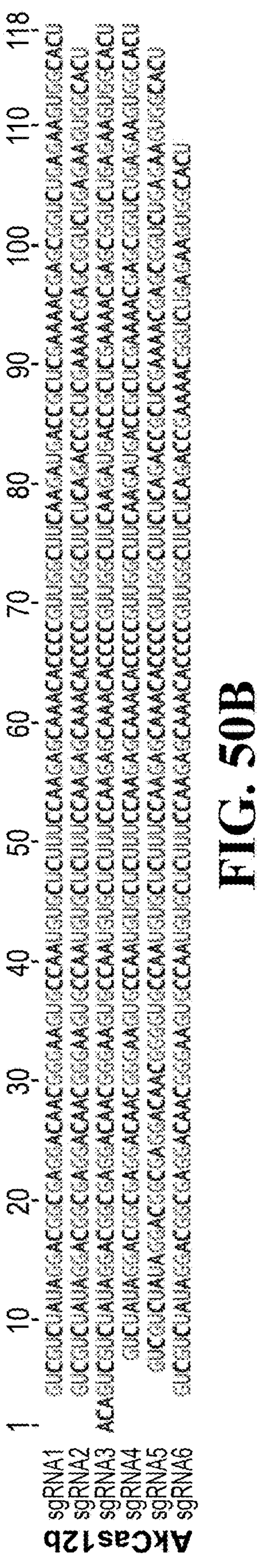
Figure 50C:
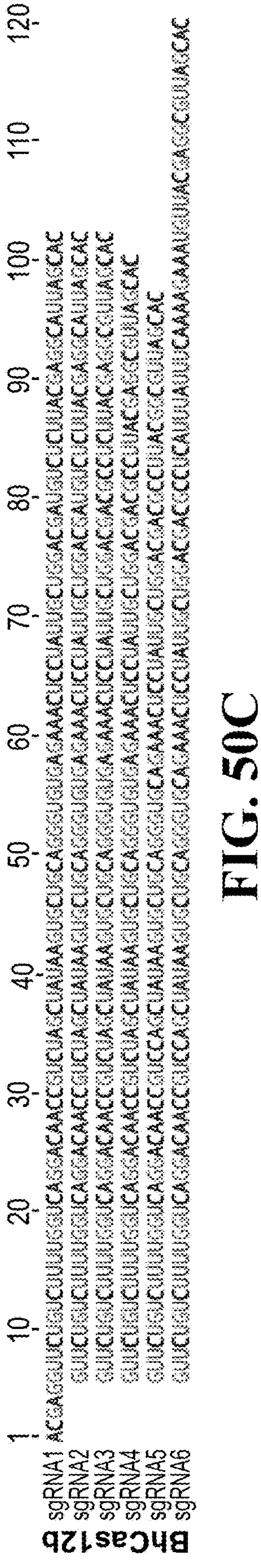
Figure 50E:
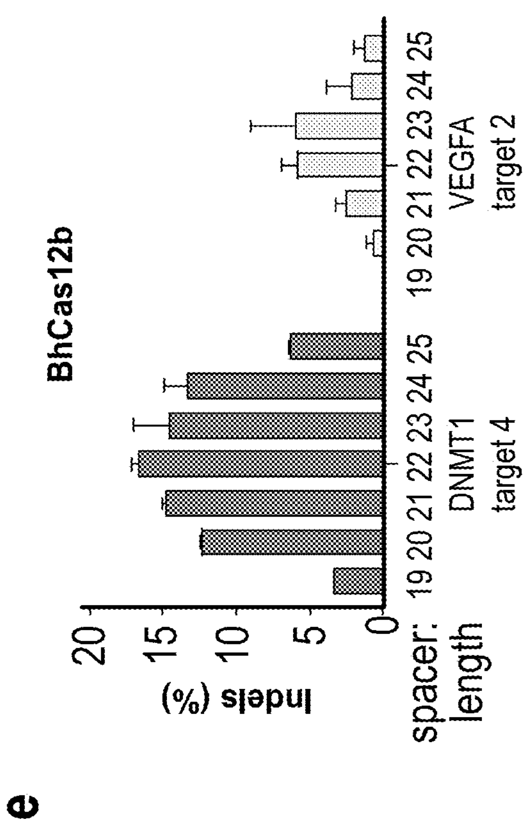
Figure 50D:
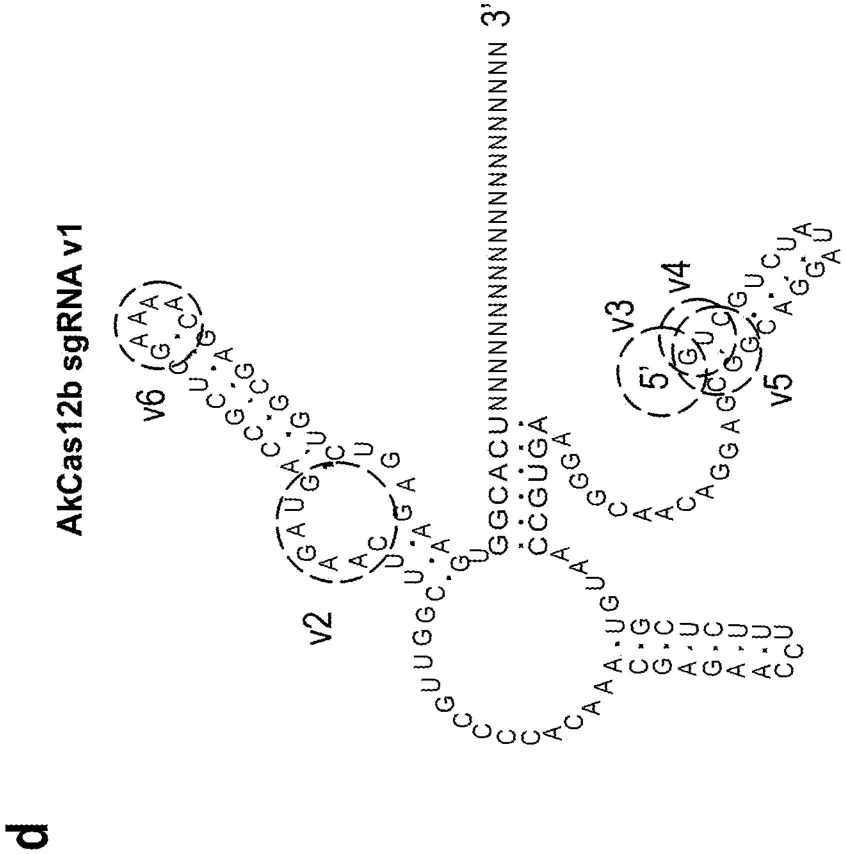

To biochemically characterize Cas12b, Applicants tested for in vitro activity with purified Cas12b protein and predicted tracrRNA and crRNA, on targets containing the identified PAM (FIG. 44*b*, FIG. 49*e*). Applicants observed only minimal activity with EbCas12b and LsCas12b, however, both AkCas12b and BhCas12b exhibited strong cleavage at 37° C., warranting further investigation in human cells. Given that genome editing in cells is more efficient with a single guide RNA (sgRNA)[13], Applicants designed sgRNAs for both AkCas12b and BhCas12b and validated their activity in vitro (FIG. 49*f*). Applicants transfected 293T cells with plasmids expressing NLS-tagged Cas12b and sgRNA driven by a U6 promoter and monitored nuclease activity through the formation of insertion or deletion (indel) mutations by targeted deep sequencing. The observed indel rate for both Cas12b proteins was detectable, but below 1% (FIGS. 44*c* and 44*d*). To increase efficiency, Applicants tested the effect of changes in the sgRNA scaffolds by altering the tracrRNA and crRNA linkage, removing hairpin mismatches, and modifying the 5' start site and spacer length (FIGS. 44*c*-44*e*, FIG. 50). Although alterations in the AkCas12b sgRNA had little effect, a 5-nt 5' truncation of the BhCas12b sgRNA substantially improved activity across multiple targets.

Figures 45A, 45B, 45C, 45D, 45E, 45F:
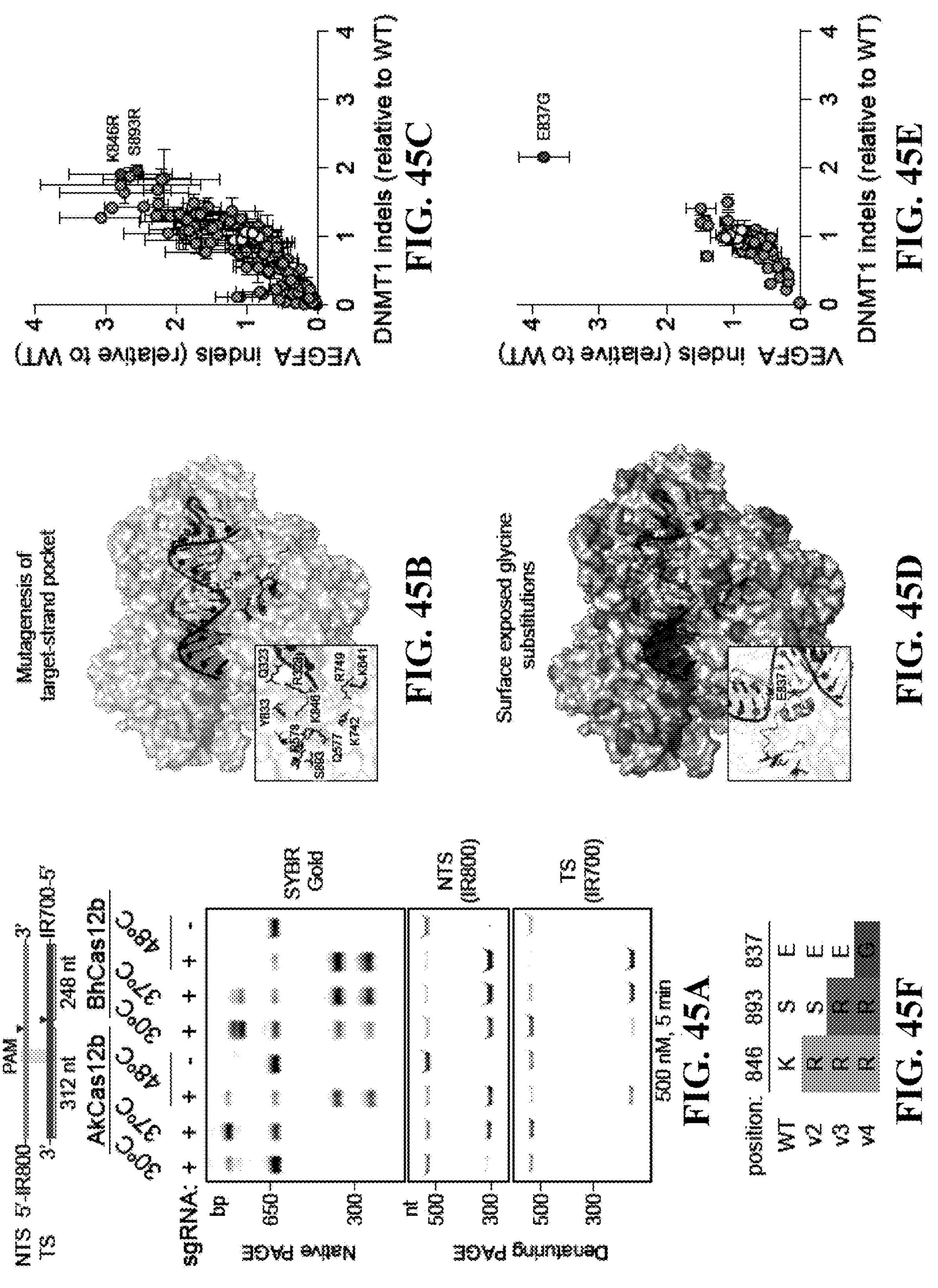
FIGS. 45A-45H. Rational engineering of BhCas12b.

Applicants frequently observed a slower migrating band during gel electrophoresis of in vitro cleavage reactions, most notably, with AkCas12b, which suggested that Cas12b can nick double stranded DNA (dsDNA) substrates (FIG. 44*b*). Reactions with differentially labelled DNA strands revealed that AkCas12b and BhCas12b preferentially cut the non-target strand, and that this behavior was more pronounced at lower temperatures (FIG. 45*a*). As the inability to cleave the target-strand reduces the potential of BhCas12b as a genome editing tool, Applicants sought to address this limitation through protein engineering.

Figure 51A:
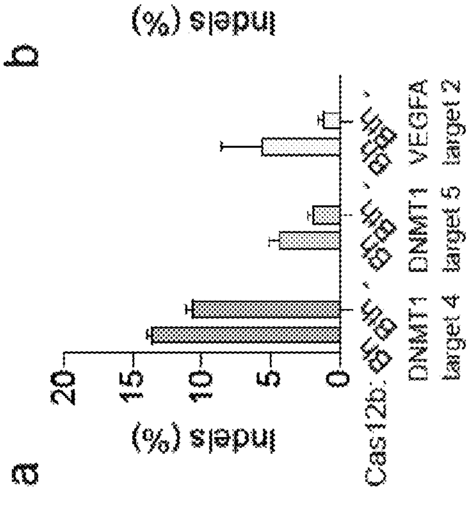
FIGS. 51A-51J. Rational engineering of BhCas12b.
Figure 51B:
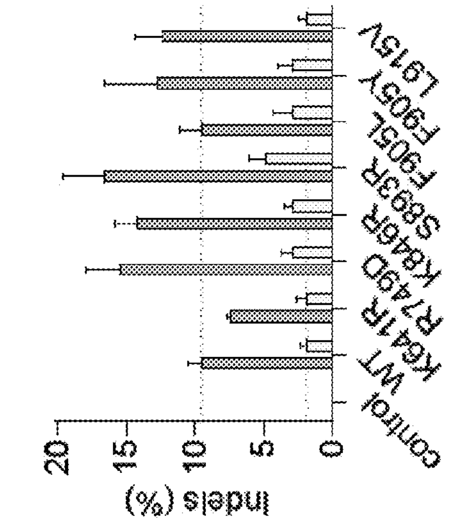
Figure 51C:
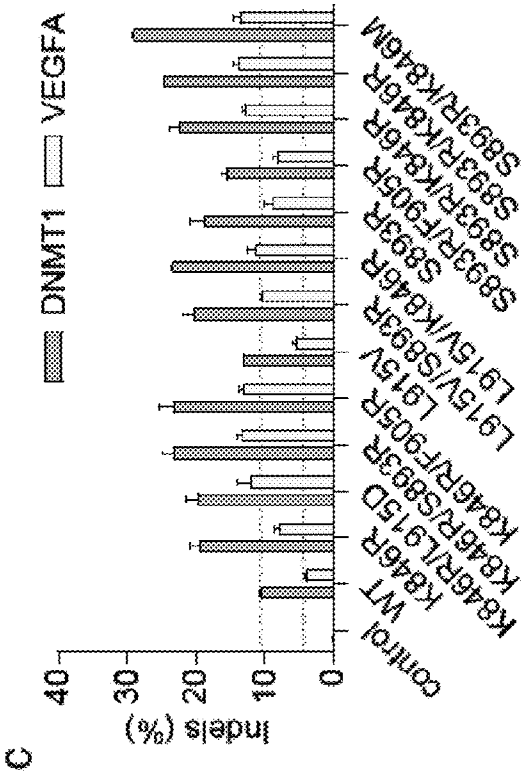
Figure 51E:
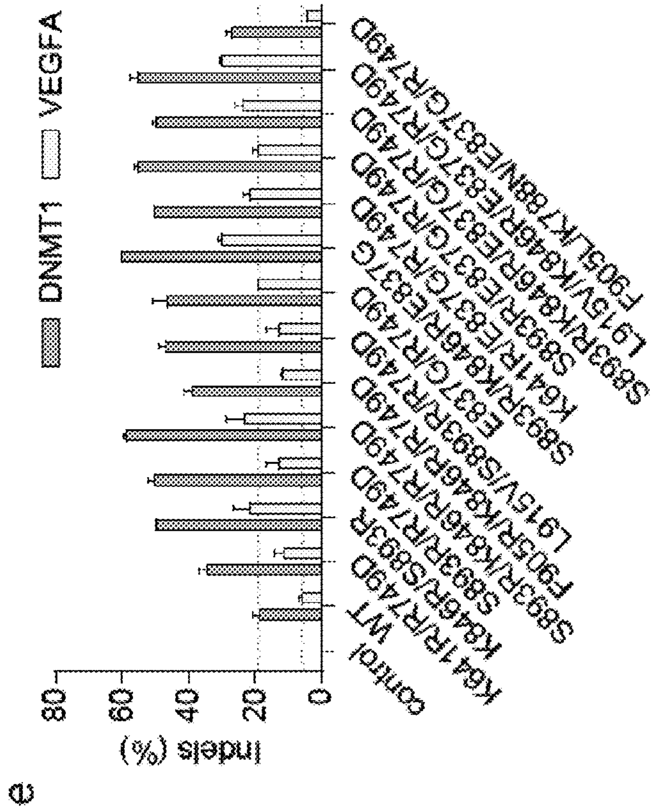
Figure 51D:
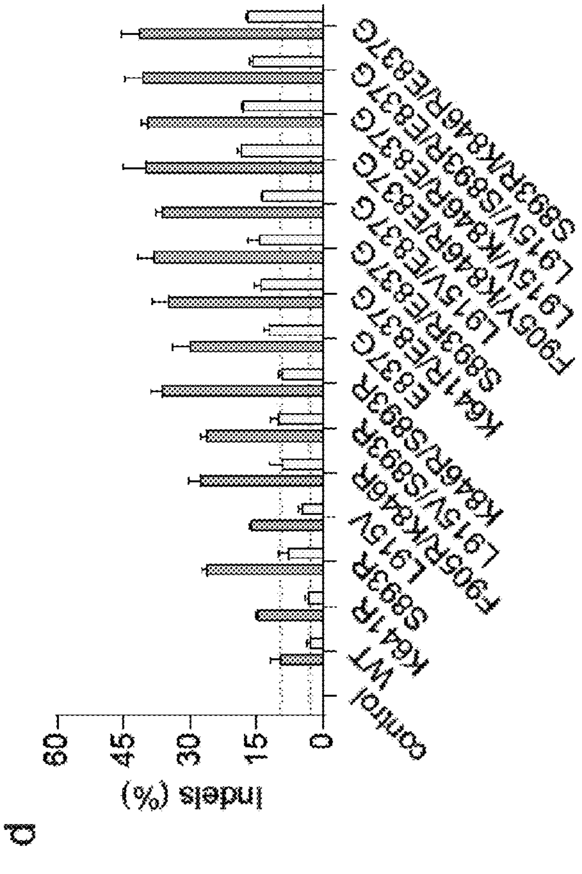
Figure 51G:
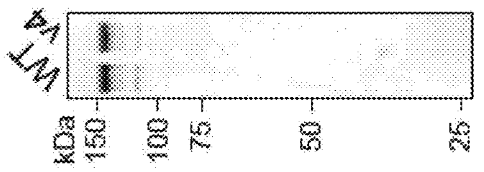
Figure 51F:
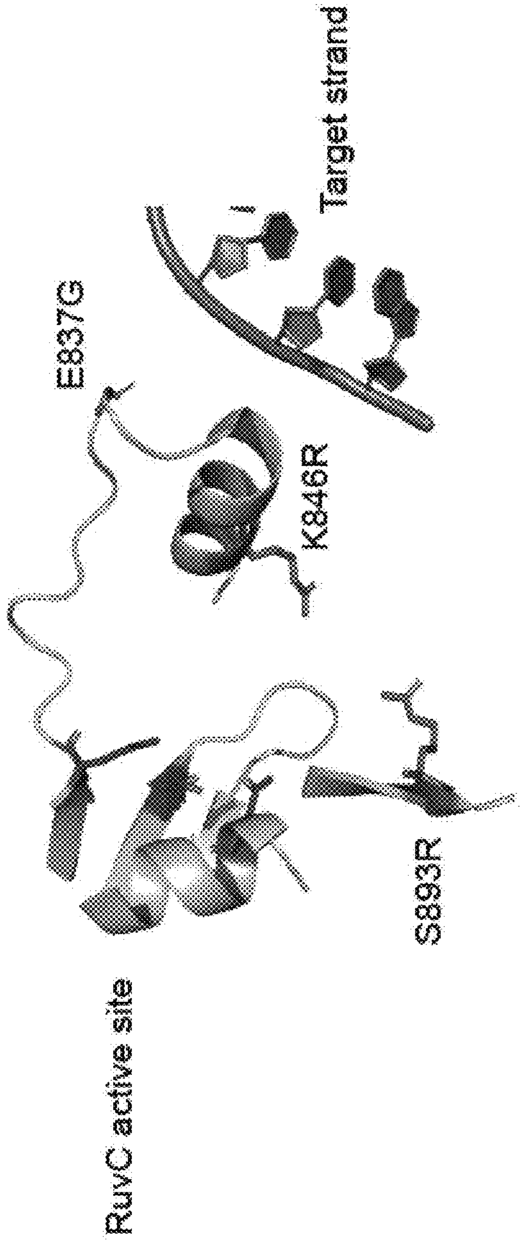
Figure 51J:
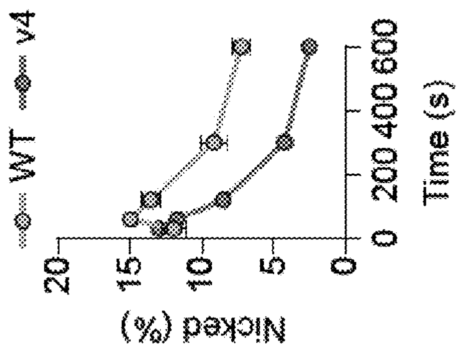
Figure 51I:
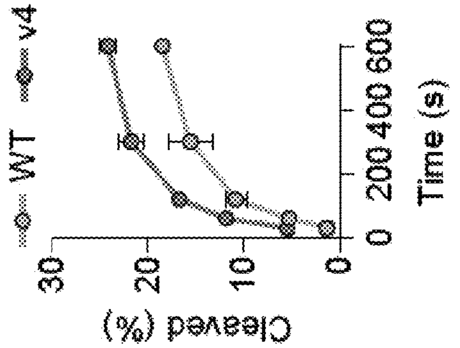
Figure 51H:
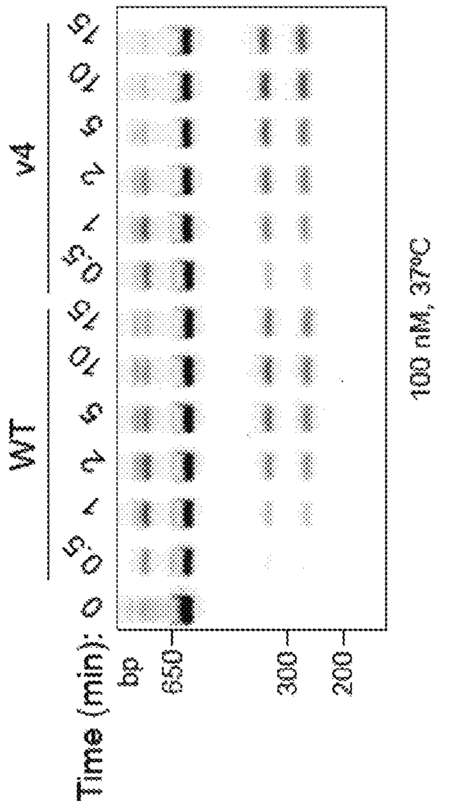
Figure 52A:
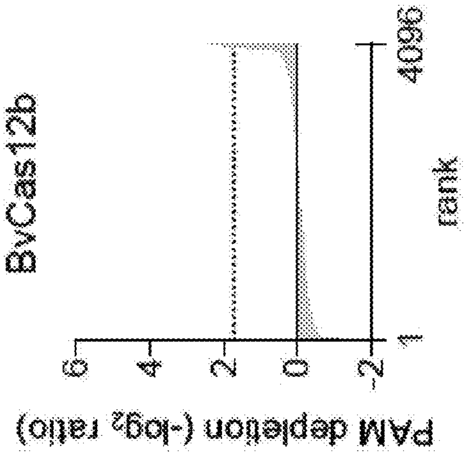
FIGS. 52A-52J. Characterization of BvCas12b.
Figure 52B:
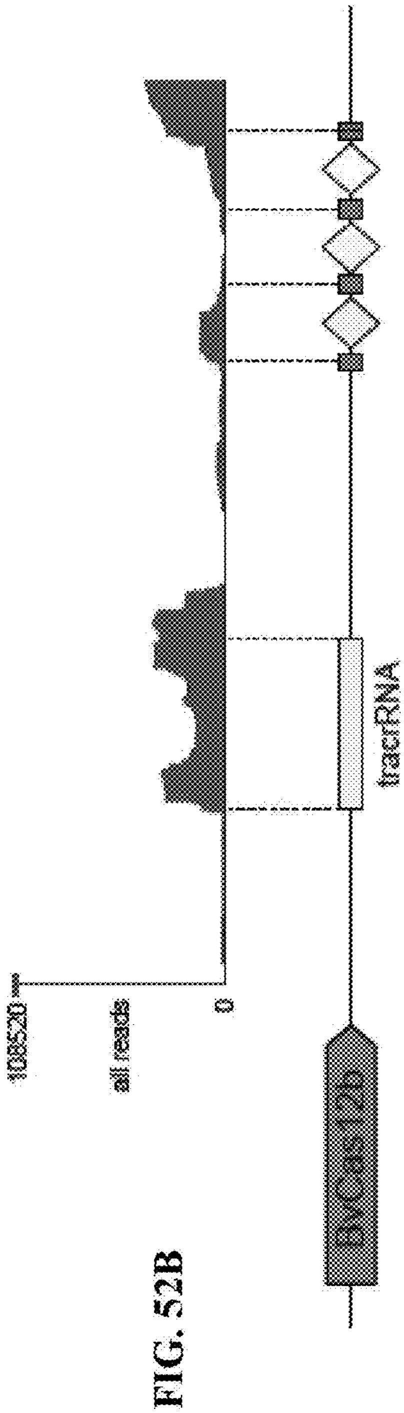
Figure 52C:
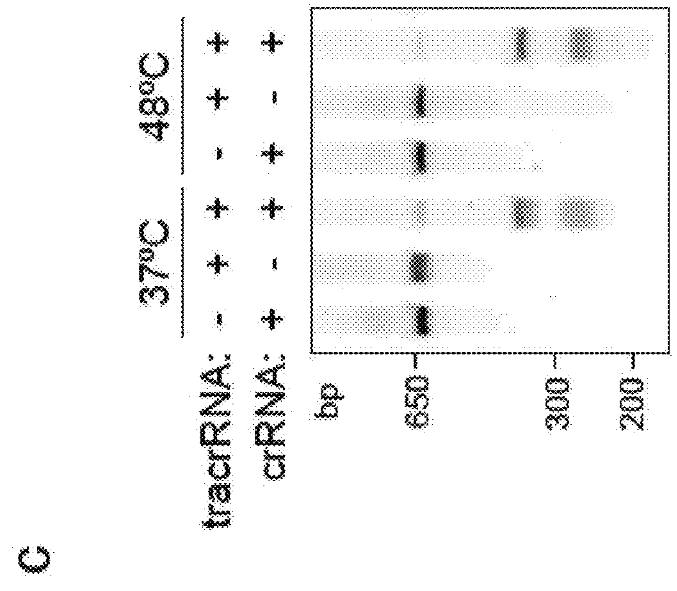
Figure 52D:
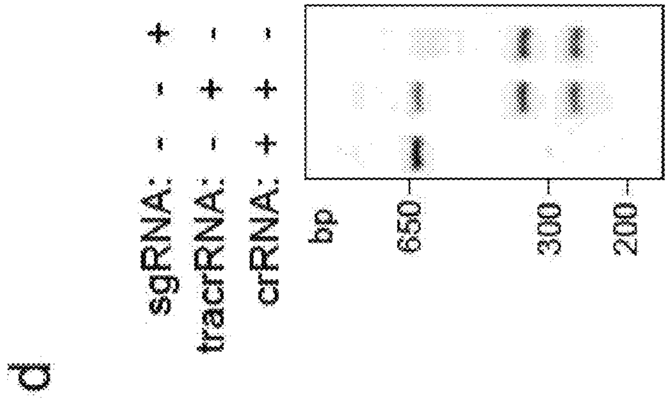
Figure 52E:
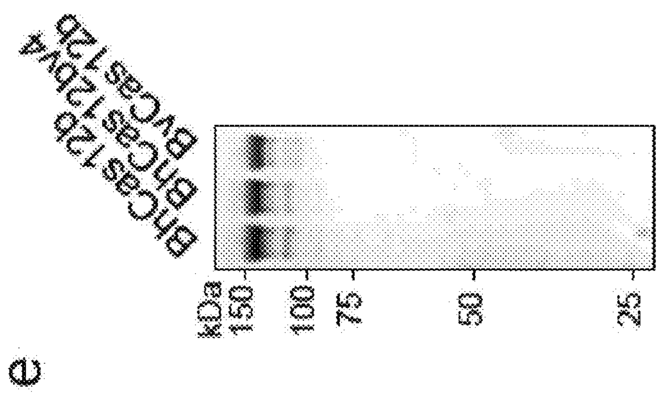
Figure 52F:
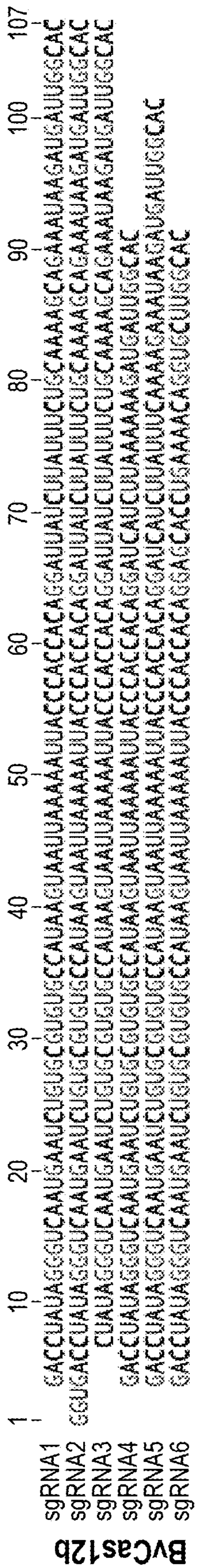
Figure 52G:
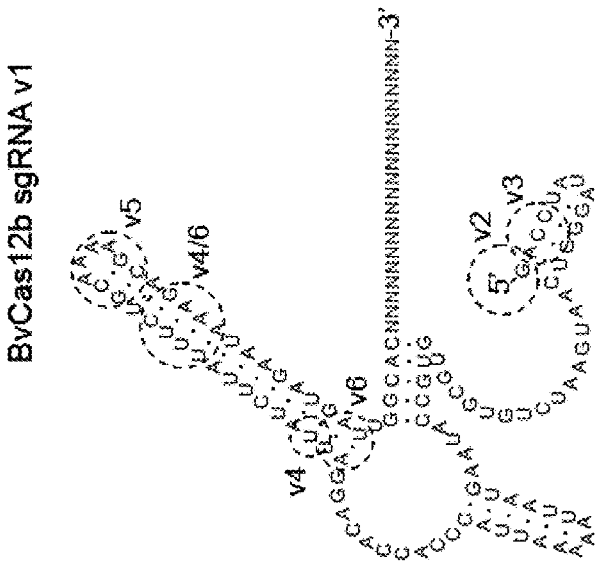
Figure 52H:
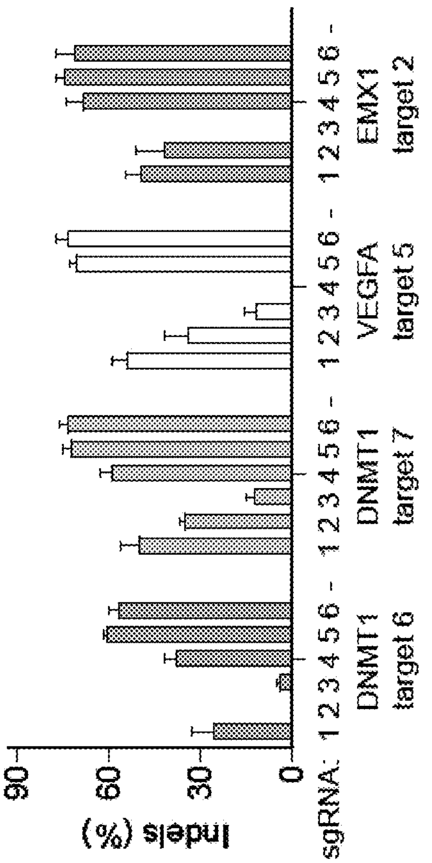
Figure 52I:
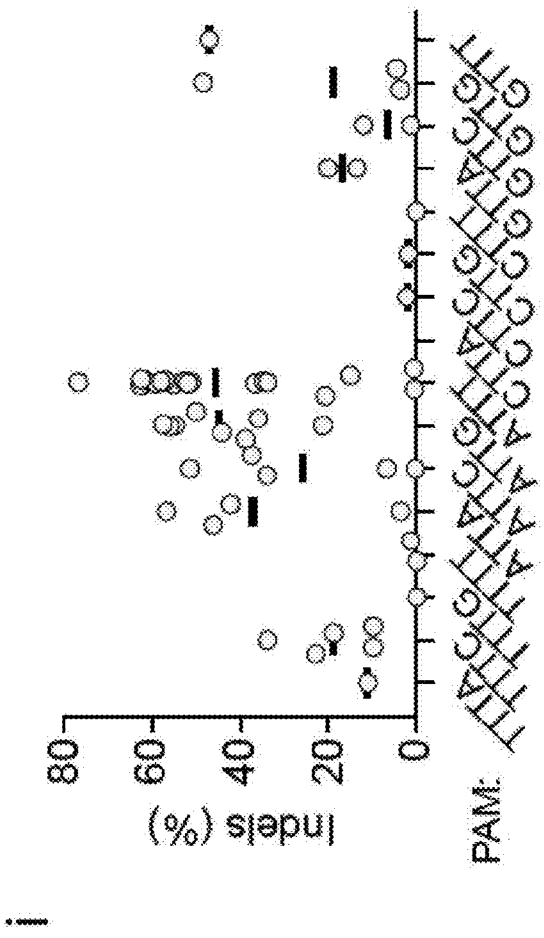
Figure 52J:
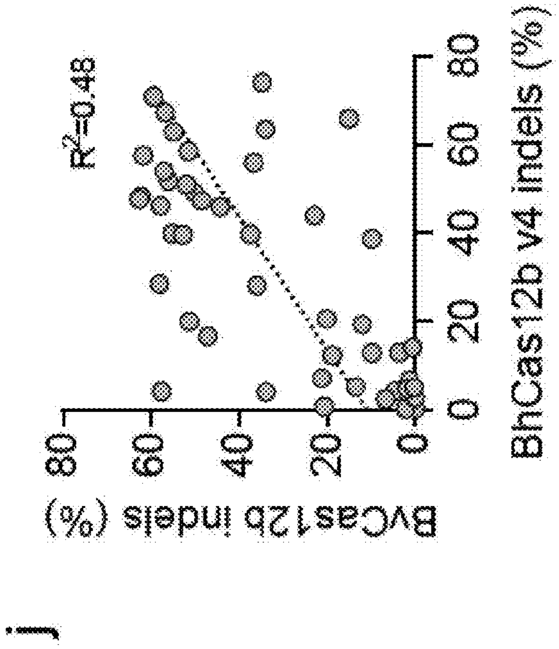

The target-strand might be poorly accessible to the RuvC active site of BhCas12b. Applicants tested whether altering the properties of this pocket in BhCas12b might improve target-strand accessibility and DNA cleavage. Applicants mutated 12 BhCas12b residues identified through alignments with AacCas12b, residues which were also conserved in the structure of the nearly identical Cas12b from *Bacillus thermoamylovorans* (BthCas12b)(BthCas12b also exhibited activity in cells, but not as efficiently as BhCas12b FIG. 51*a*)[15]. Applicants measured indel activity at two target sites with a total of 268 BhCas12b single mutants and found increased activity with several mutations including K846R and S893R, which exhibited additive effects as a double mutant (FIGS. 45*b* and 45*c*, FIGS. 51*b* and 51*c*). As positively charged arginine side chains often interact with the backbone of nucleic acids[16], it is possible that increased DNA-binding affinity of the mutants helps pull the target-strand towards the RuvC active site and promote DNA cleavage.

Figure 45G:
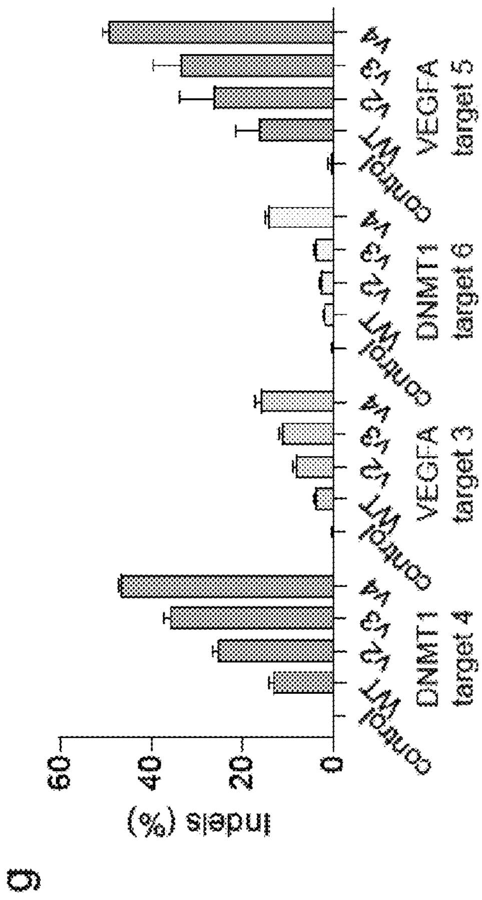
Figure 45H:
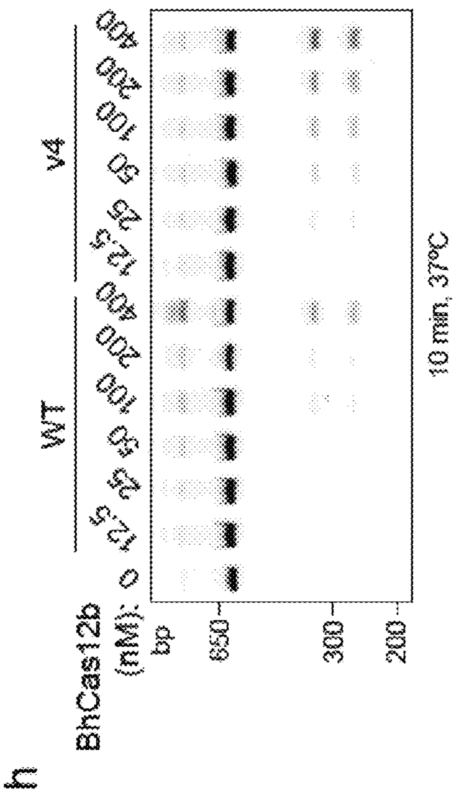

As an orthogonal approach, Applicants sought to address the temperature-dependence of target-strand cleavage. Applicants generated glycine substitutions at 66 surface exposed residues and again tested for indel activity at two target sites. Strikingly, Applicants observed over 2-fold improvement relative to wild-type with the E837G variant, a position that is located between the guide RNA:DNA duplex and the RuvC active site (FIGS. 45*d* and 45*e*). Testing combinations of mutations led to progressively active variants with a final BhCas12b v4 mutant containing K846R/S893R/E837G that exhibited the highest activity across multiple targets (FIGS. 45*f* and 45*g*). In agreement with these results in human cells, purified BhCas12b v4 protein exhibited increased dsDNA cleavage activity at 37° C. and a clear reduction of nicked dsDNA (FIG. 45*h*, FIGS. 51*g*-51*j*).

Figure 53A:
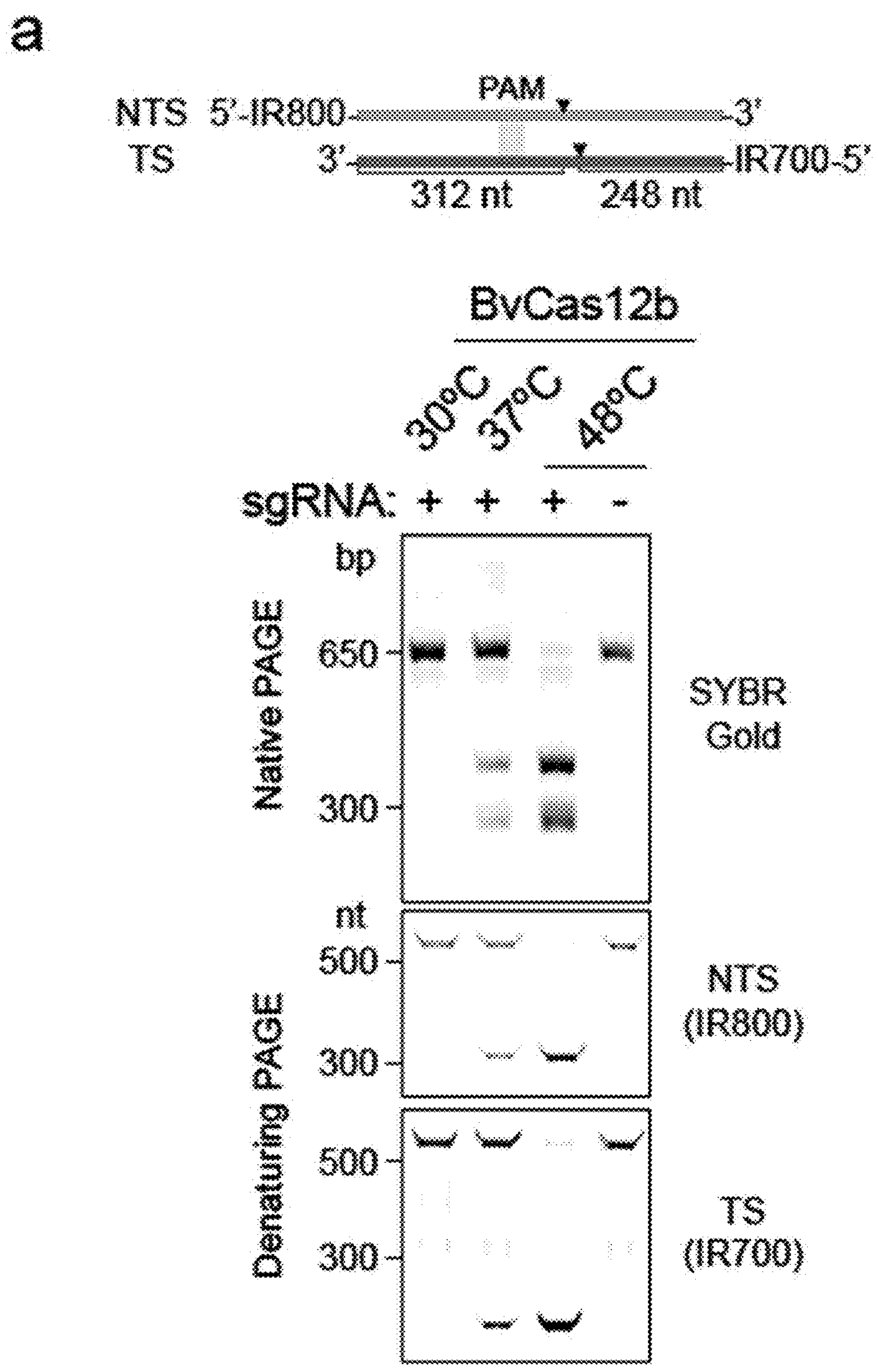
FIGS. 53A-53E. Mutagenesis of BvCas12b.
Figures 53B, 53C:
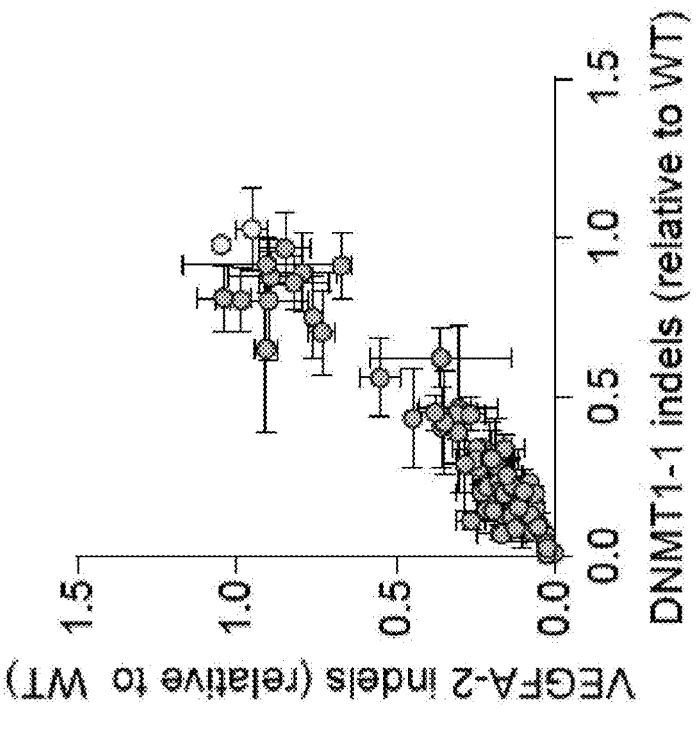
Figure 53E:
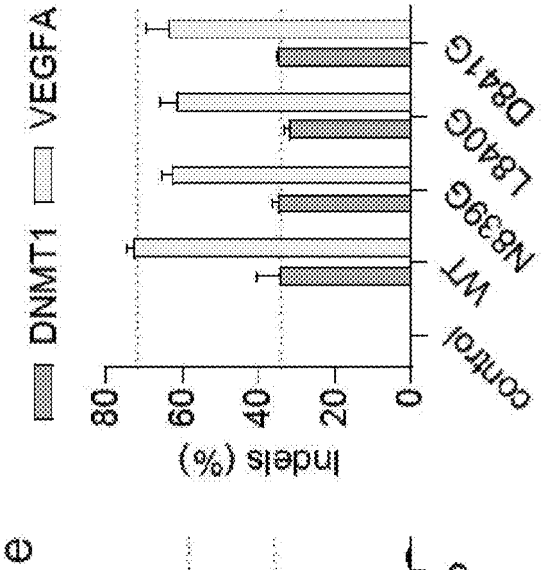
Figure 53D:
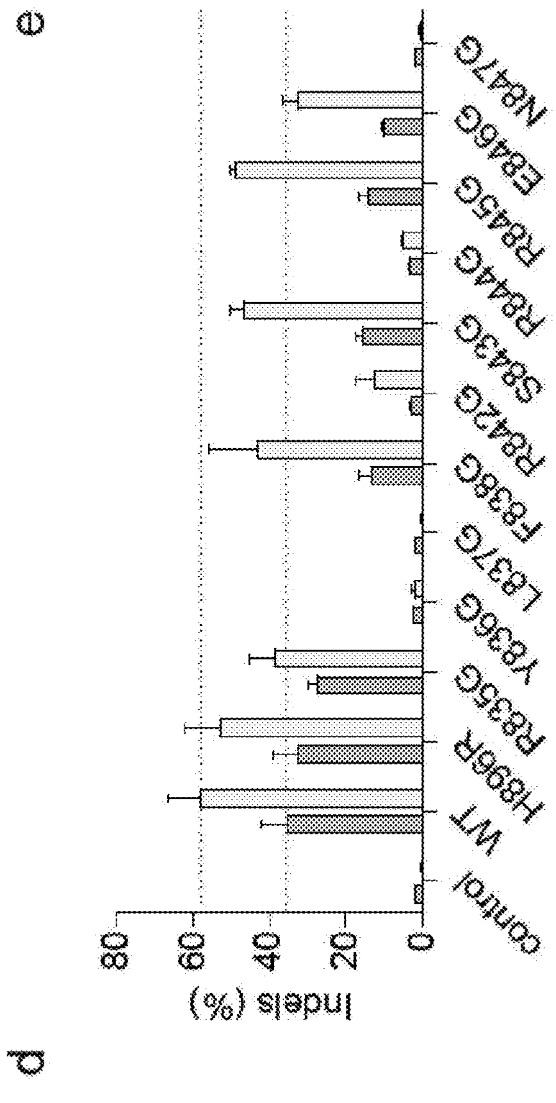

Applicant's initial selection of Cas12b enzymes avoided orthologs from the same species to increase the diversity of the screened variants. However, given the positive genome editing results with BhCas12b, Applicants revisited *Bacillus* sp. members and found a Cas12b ortholog encoded in the recently deposited genome from *Bacillus* sp. V3-13[2] (4100 sequence identity to BhCas12b), which was isolated from the clean room where the Viking spacecrafts were assembled[2]. Applicants characterized this protein, herein referred to as BvCas12b, and found that BvCas12b efficiently cleaves target DNA with an ATTN PAM at 37° C. (FIG. 52). Interestingly, the BhCas12b v4 mutations K846R and S893R correspond to R849 and H896 in BvCas12b respectively (FIG. 53*a*), suggesting that BvCas12b might have naturally evolved optimal dsDNA cleavage activity. Consistent with this idea, Applicants did not detect any nicking products with BvCas12b in vitro (FIG. 53*b*). In addition, targeted mutations in the target-strand pocket of BvCas12b all decreased activity, as did glycine substitutions corresponding to BhCas12b E837G (FIG. 53*c*-53*e*).

Figure 46B:
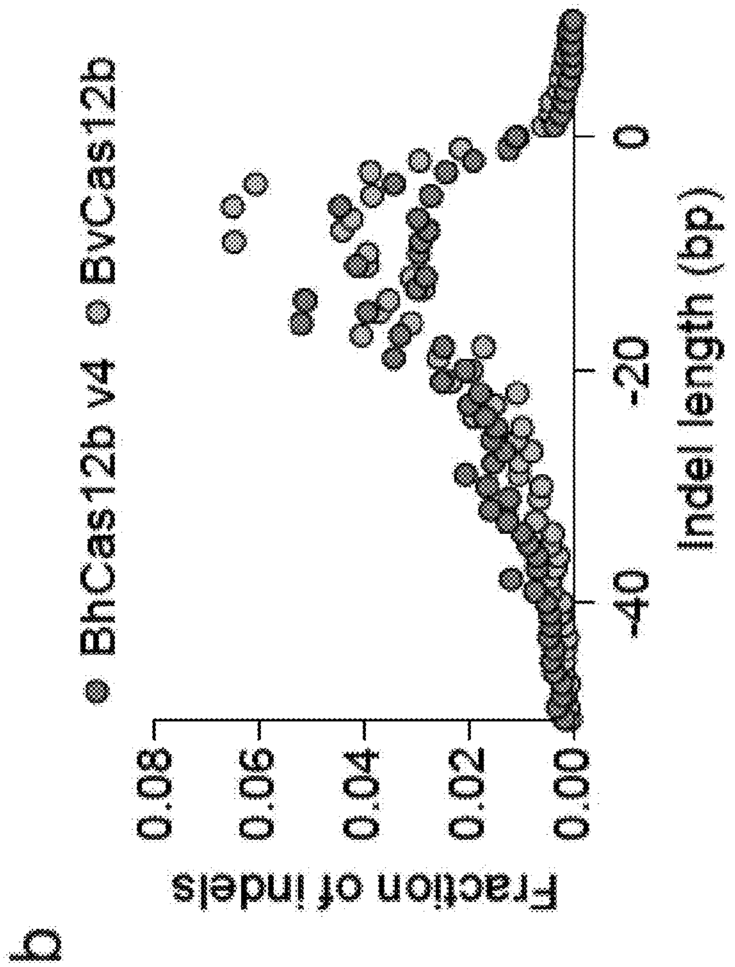
FIGS. 46A-46G. BhCas12b v4 and BvCas12b mediate genome editing in human cell lines.
Figure 46A:
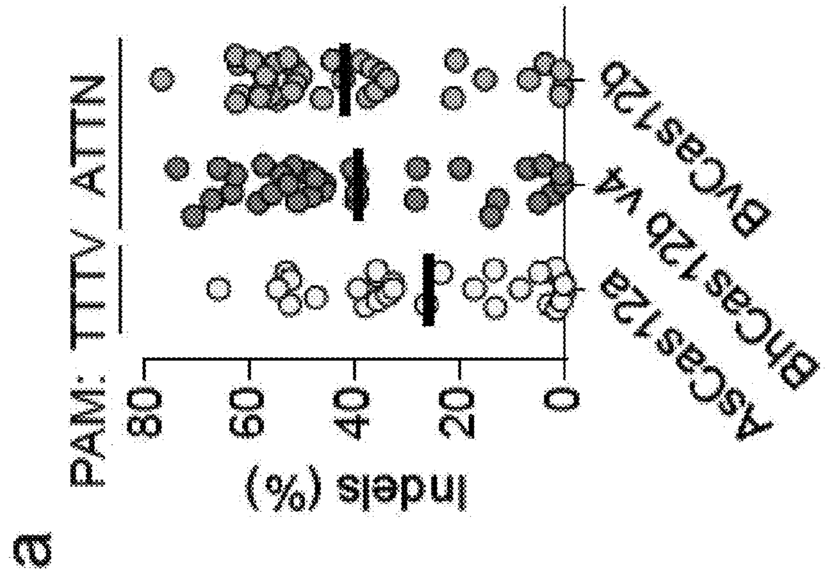
Figure 46C:
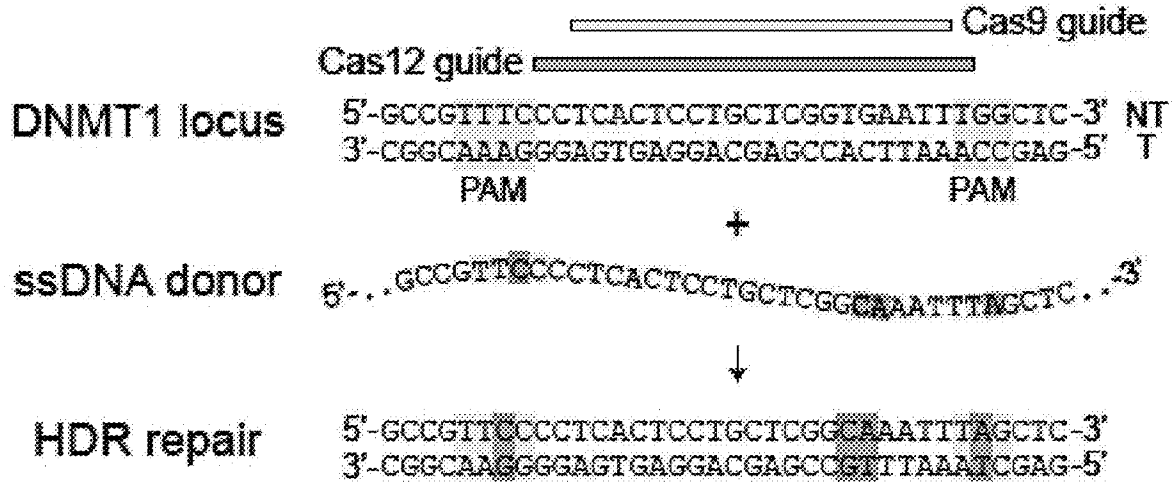
Figure 46E:
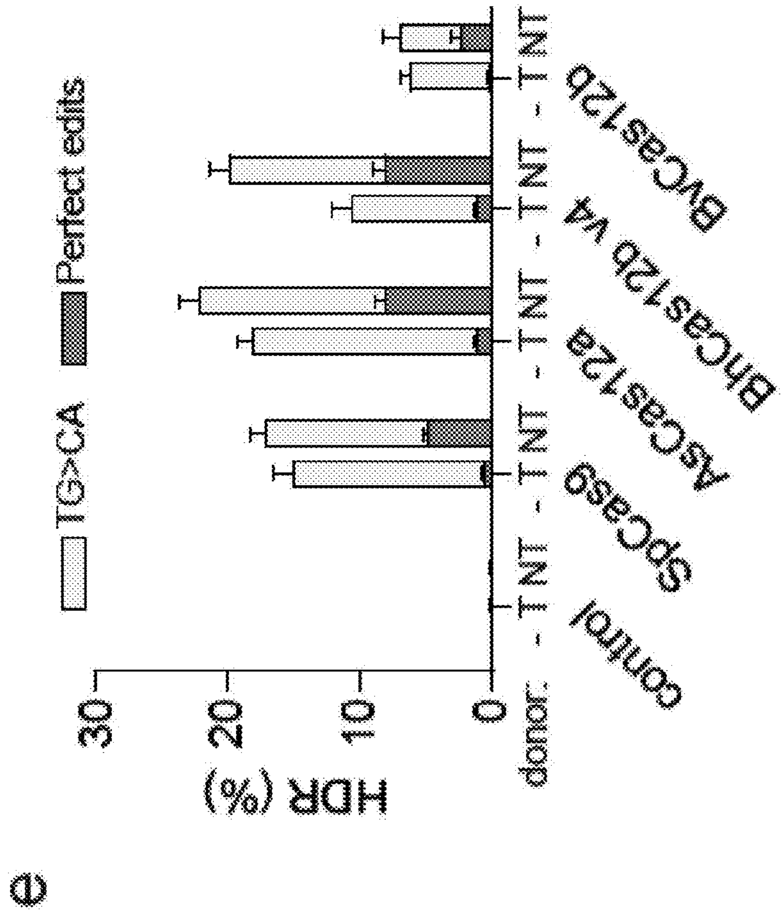
Figure 46D:
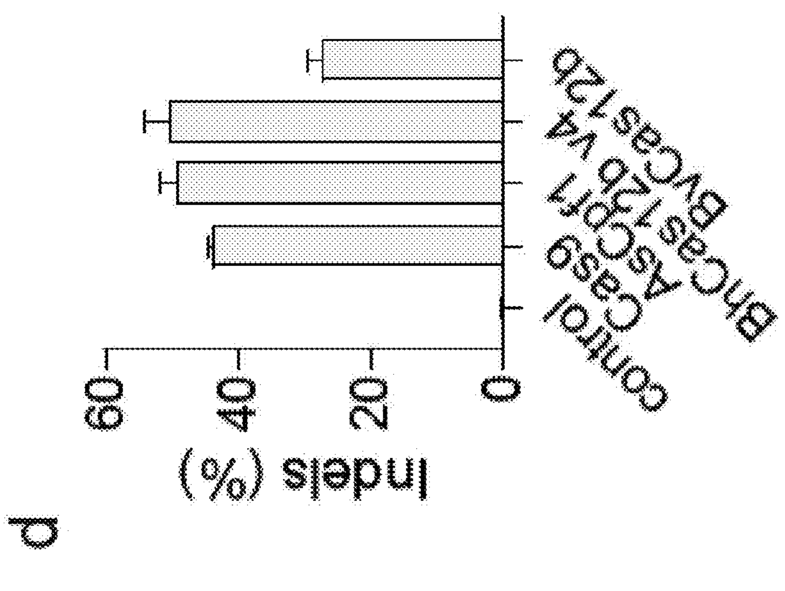
Figure 46G:
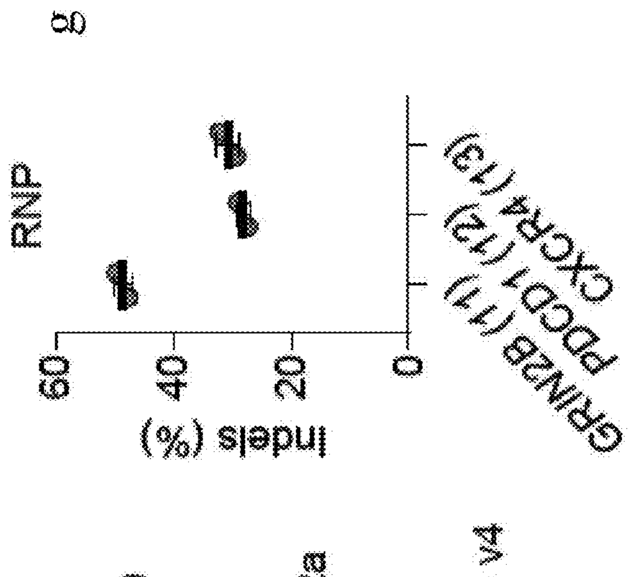
Figure 46F:
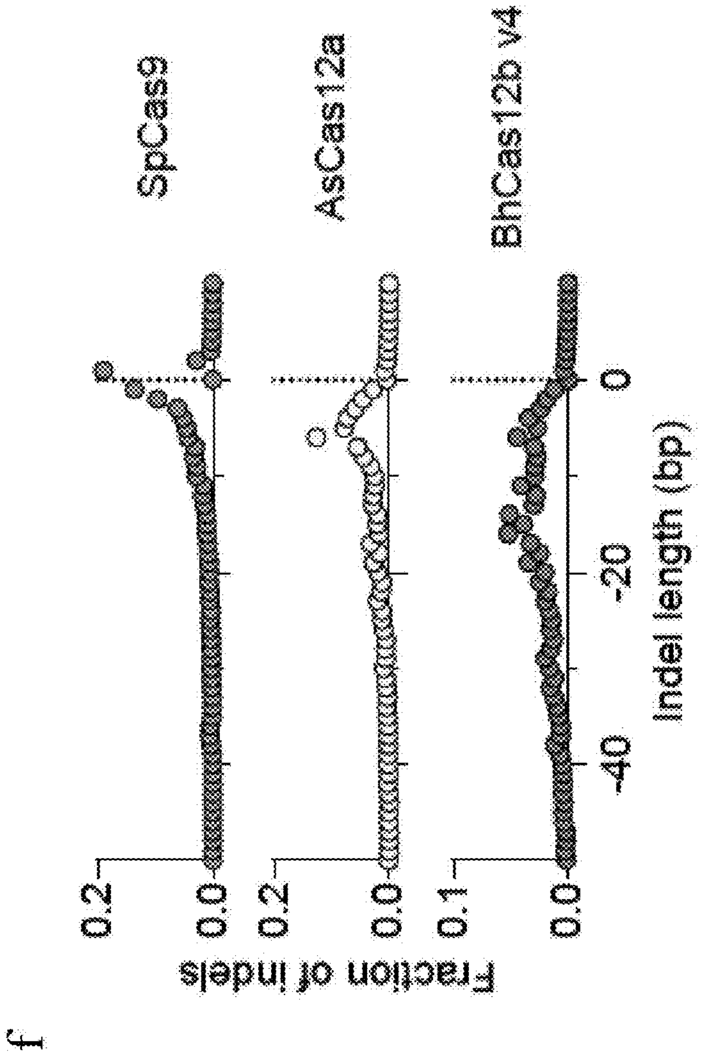
Figure 54A:
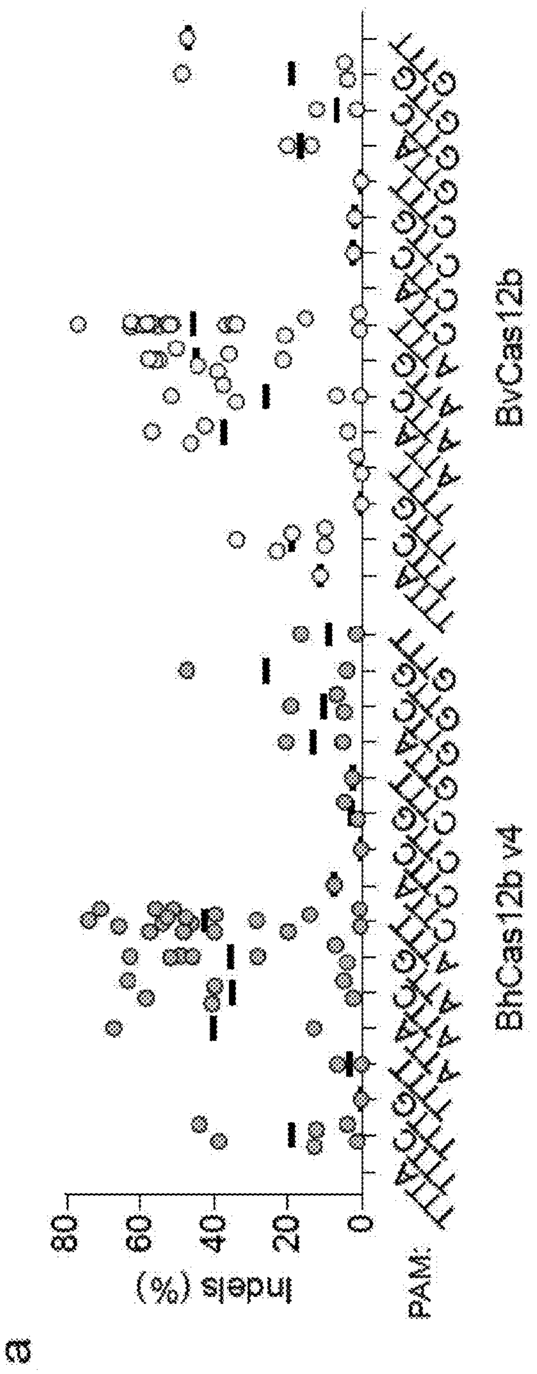
FIGS. 54A-54F. BhCas12b v4 and BvCas12b mediated genome editing in human cells lines.
Figure 54B:
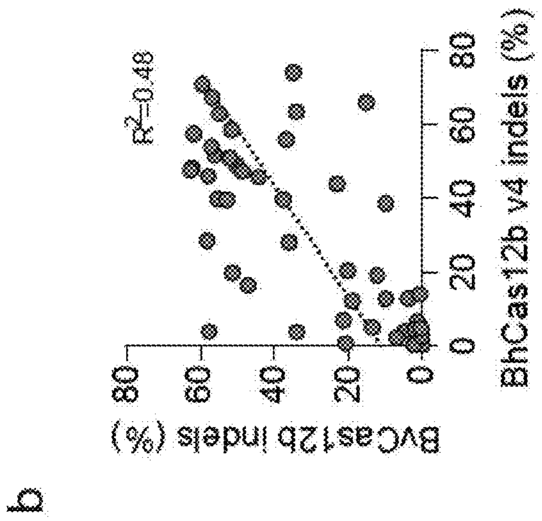
Figure 54C:
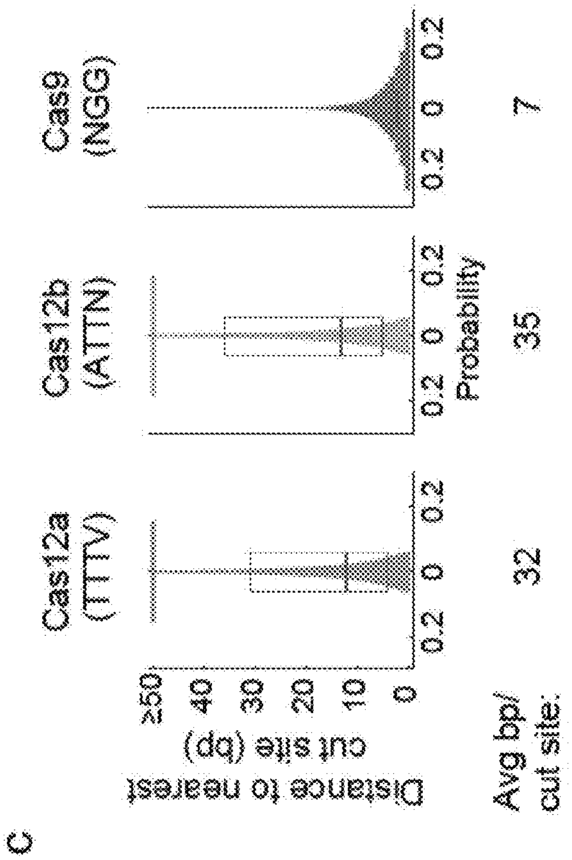
Figure 54D:
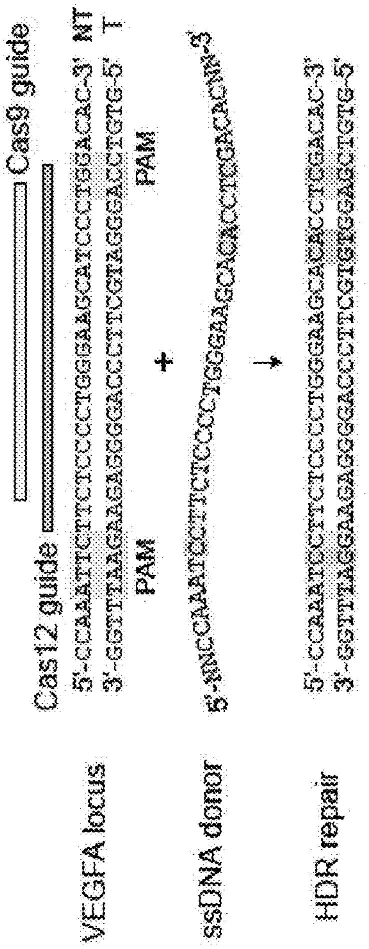
Figure 54E:
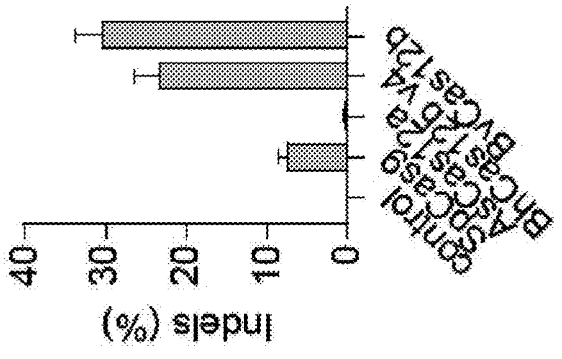
Figure 54F:
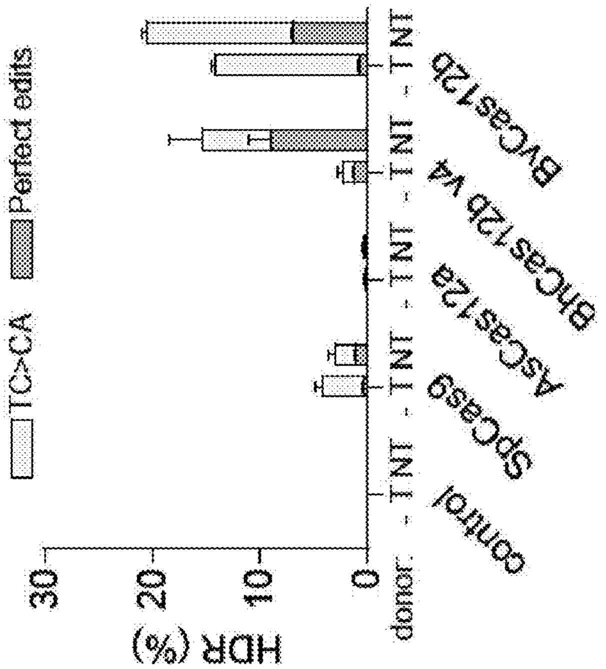

Robust genome editing tools may be desired to be effective and specific across a range of targets. Applicants investigated Cas12b activity more thoroughly in comparison to previously studied Cas nucleases. Applicants tested BhCas12b v4 and BvCas12b at 56 targets across 5 genes in 293T cells and found robust cleavage at ATTN PAMs using AsCas12a at TTTV PAMs as a positive control (FIG. 46*a*). Analysis of the indel patterns formed by Cas12b revealed predominant 5-15-bp deletions (FIG. 46*b*). Applicants also observed high Cas12b activity at a subset of TTTN and GTTN PAMs, although this activity was less robust (FIG. 54*a*). Applicants observed only a weak correlation between the activities of BhCas12b v4 and BvCas12b at matched sites ($R^2$=0.48), and numerous targets were more efficiently cleaved by one of the two nucleases (FIG. 54*b*). These findings emphasize the benefit of multiple orthologs and the continued need to thoroughly investigate the targeting rules of Cas nucleases. Analysis of ATTN prevalence in the human genome revealed similar targetability to Cas12a enzymes (FIG. 54*c*). In contrast to SpCas9 and AsCas12a, analysis of the indel patterns formed by BhCas12b revealed prominent larger deletions of 5-15 bp (FIG. 46*f*). Co-transfection of Cas12b nucleases with single-strand oligonucleotide (ssODN) donors led to comparable editing efficiency as SpCas9 and AsCas12a at a TTTC PAM target (FIGS. 46*c*-46*e*), and higher editing efficiency at an ATTC PAM target (FIGS. 54*d*-54*f*). To further evaluate the efficacy of BhCas12b v4 in human cells, Applicants tested the ability of Cas12b ribonucleoproteins (RNPs) to edit primary human T cells. Applicants generated BhCas12b v4-sgRNA complexes and delivered them into human CD4+ T cells by electroporation. BhCas12b v4 RNPs exhibited indel rates of 32-49% across 3 tested targets (FIG. 46*g*). Together, these data indicate that BhCas12 v4 and BvCas12b can be harnessed as functional programmable nucleases in a variety of genome editing contexts, including in a therapeutically relevant human cell type.

Figures 47A, 47B:
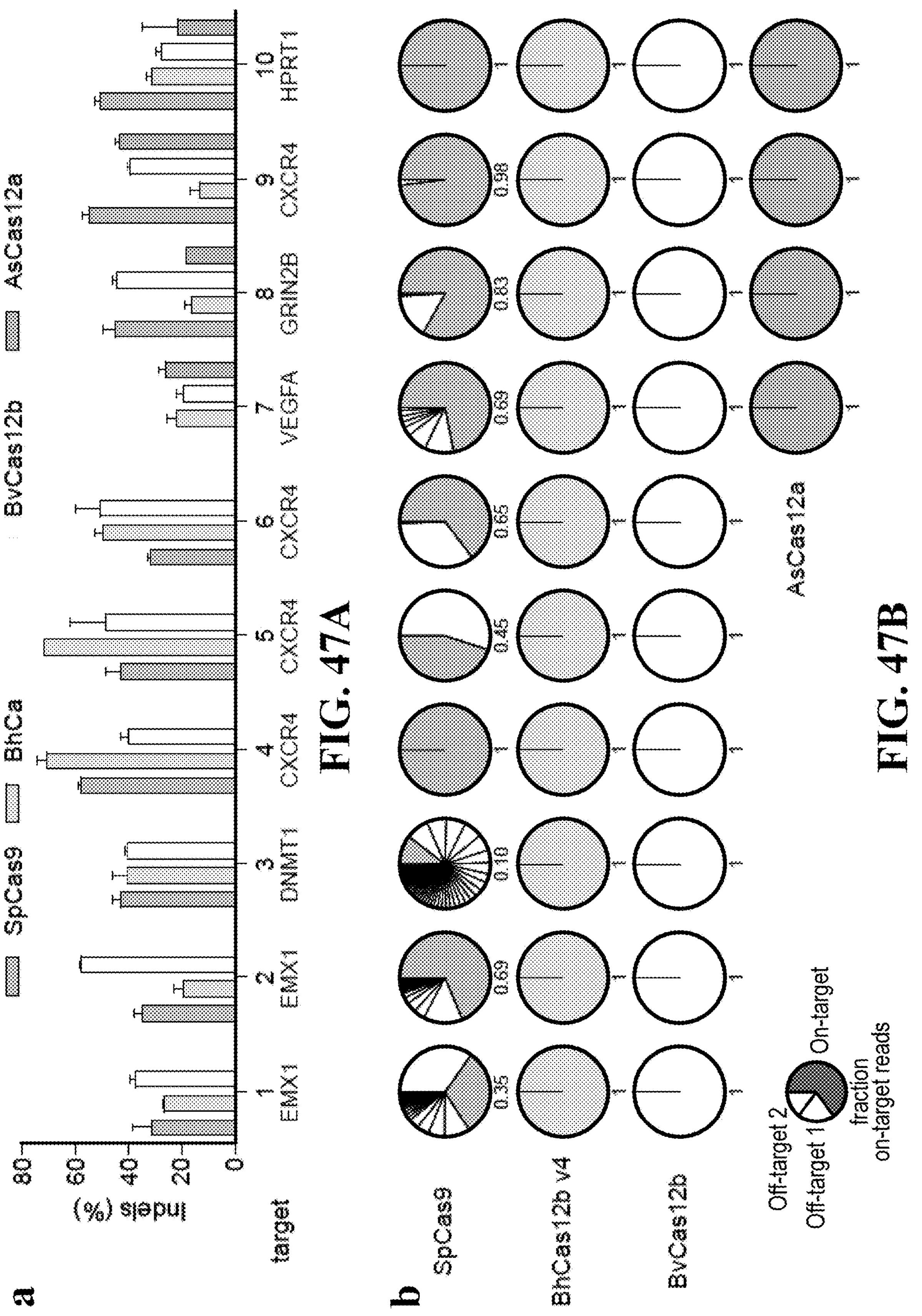
FIGS. 47A-47B. BhCas12b v4 and BvCas12b are highly specific nucleases.
Figure 55A:
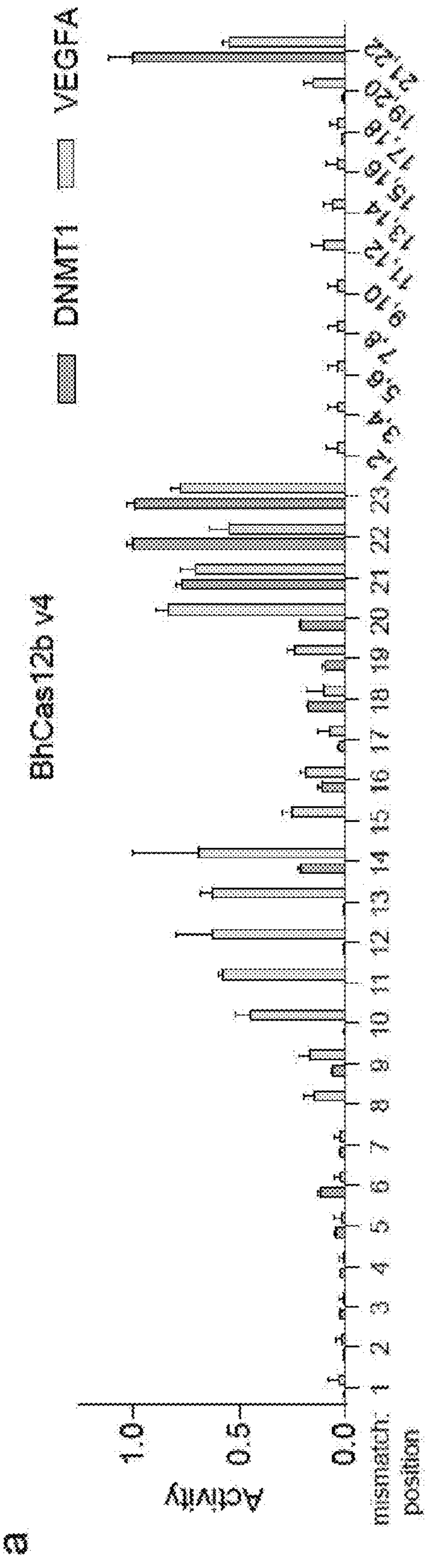
FIGS. 55A-55C. BhCas12b v4 and BvCas12b mismatch tolerance and specificity.
Figure 55B:
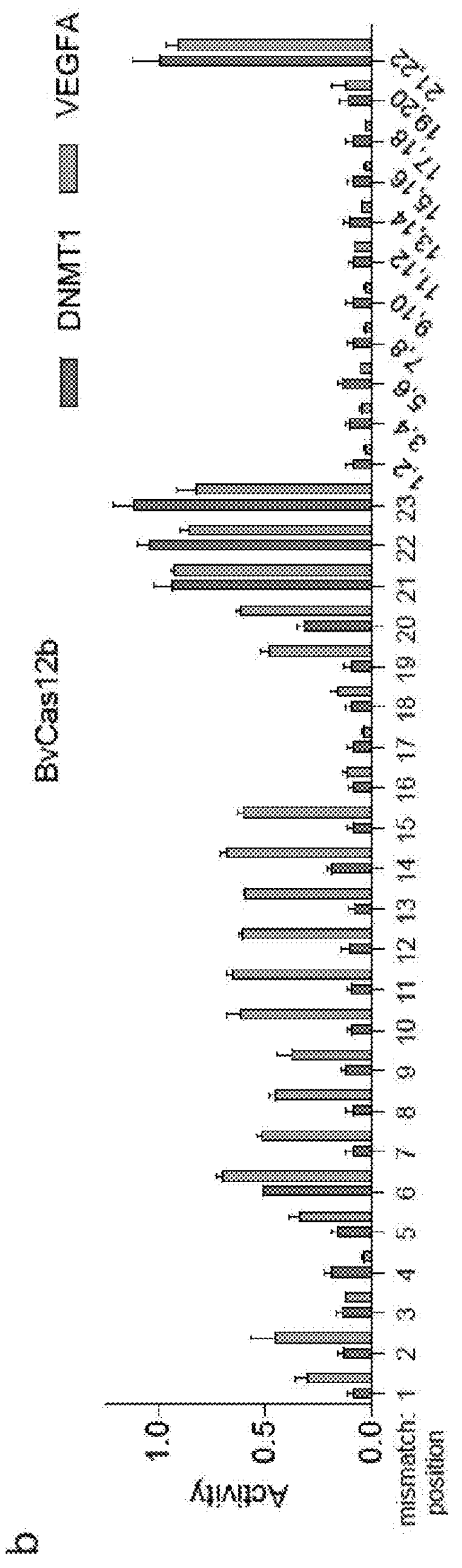
Figure 55C:
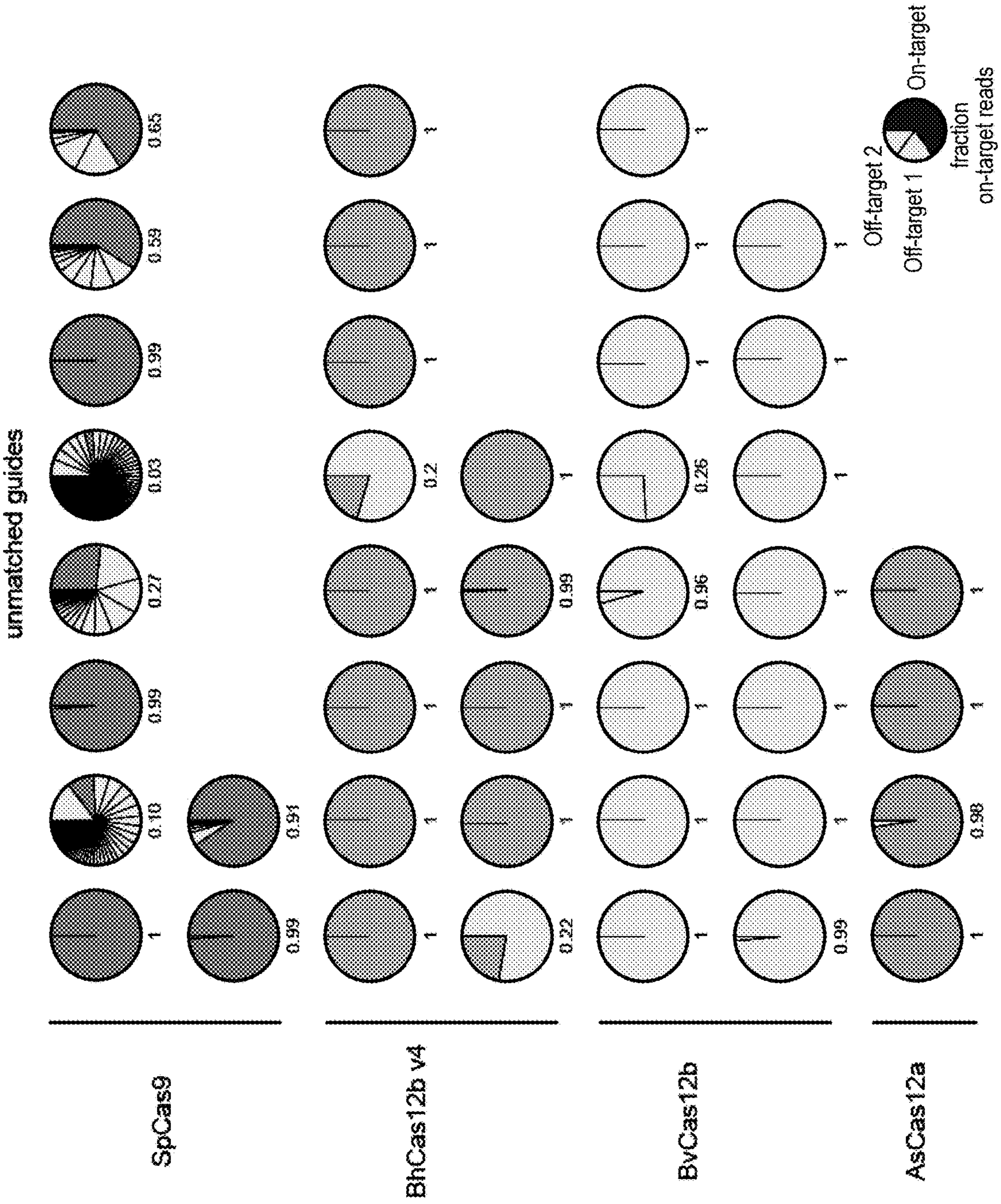
Figure 56A:
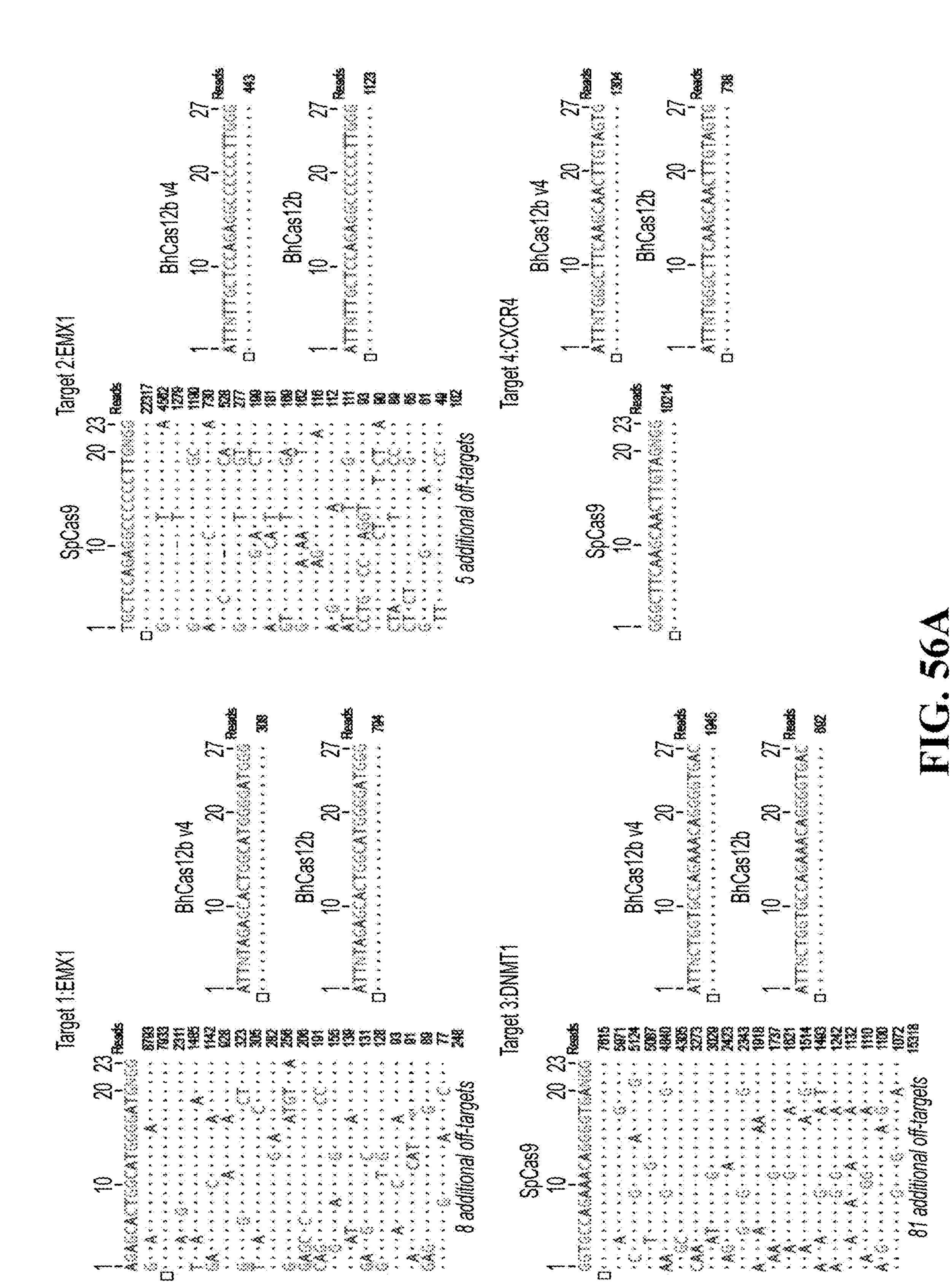
FIG. 56A) Guide-Seq analysis of unmatched targets showing the number and relative proportion of detected cleavage sites for each nuclease. Off-targets are shown as light grey wedges while the on-target site is highlighted in blue with the fraction of on-target reads shown below. See FIGS. 57A-57D for full analysis.
Figure 56B:
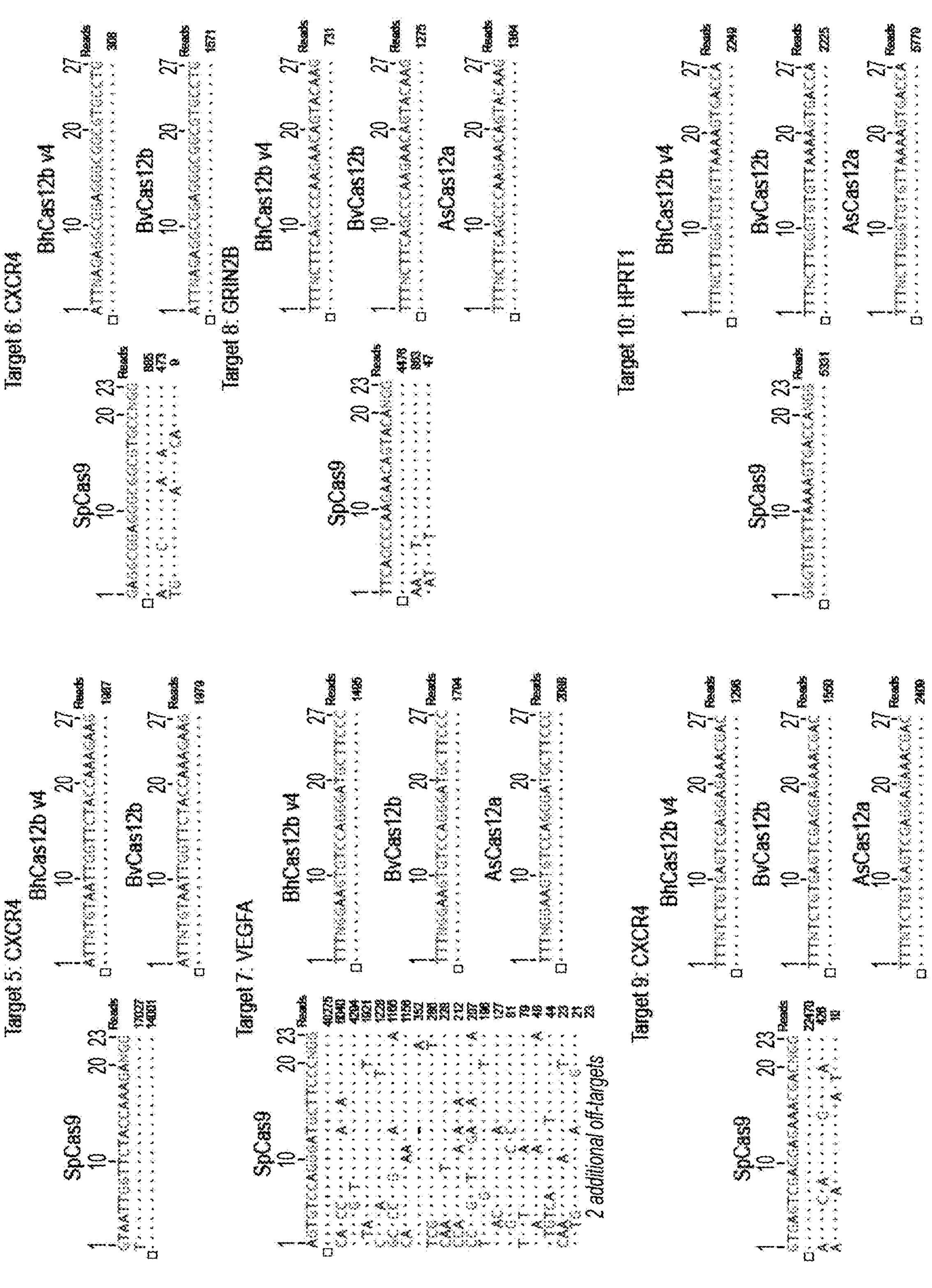
Figure 57A:
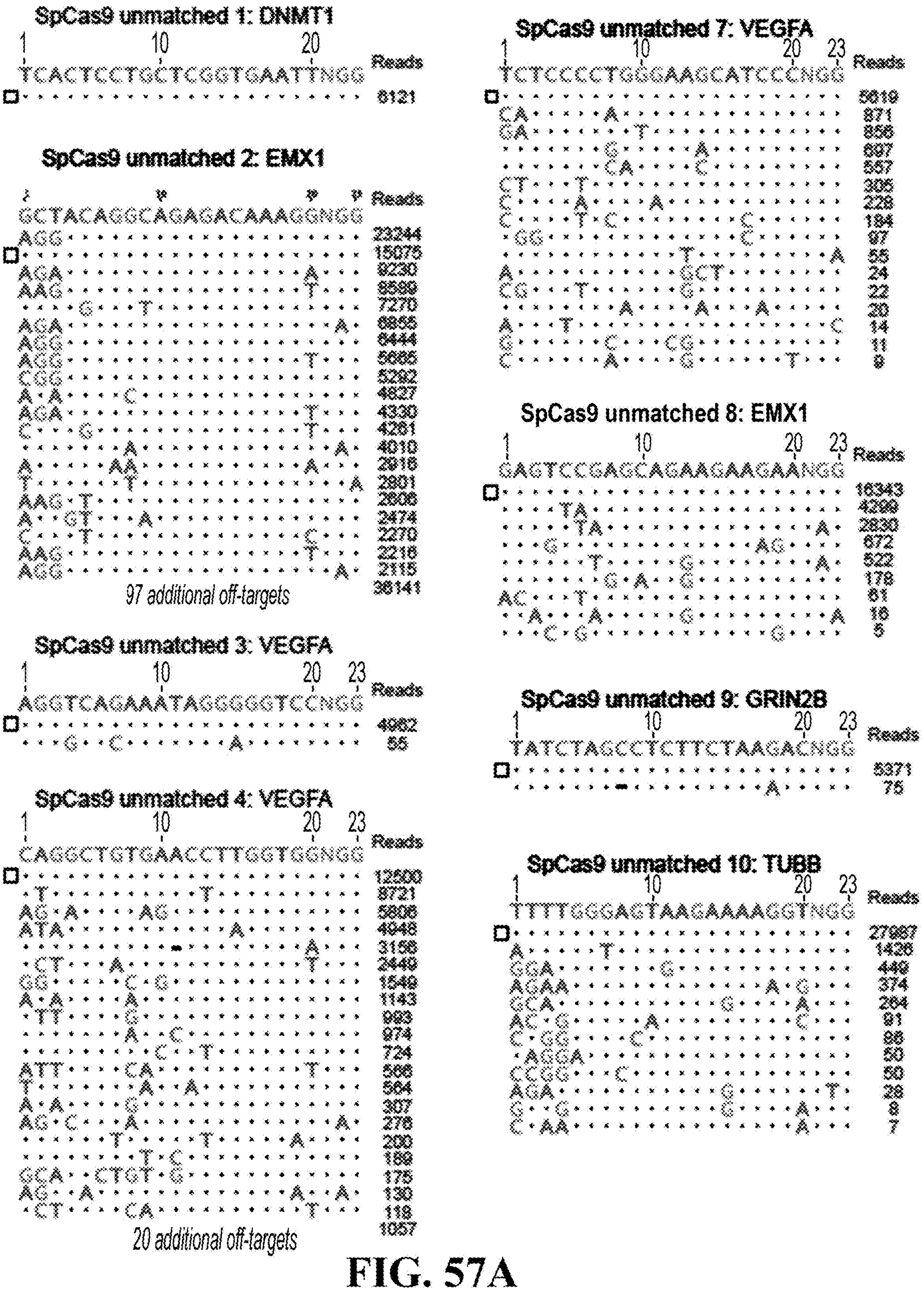
FIGS. 57A-57D. Specificity analysis of unmatched CRISPR-Cas nuclease targets. Full Guide-Seq analysis of detected off-targets in FIGS. 56A-56B. A list of detected cleavage sites (up to 20 per target) is presented for each nuclease with the on-target site denoted with a small box. Mismatches to the guide sequence are highlighted. SpCas9 unmatched 1:DNMT1 (SEQ ID NO: 226); SpCas9 unmatched 2:EMX1 (SEQ ID NO: 227-246); SpCas9 unmatched 3:VEGFA (SEQ ID NO: 247-248); SpCas9 unmatched 4:VEGFA (SEQ ID NO: 249-268); SpCas9 unmatched 5:VEGFA (SEQ ID NO: 269-288); SpCas9 unmatched 6:GRIN2B (SEQ ID NO: 289-290); AsCas12a unmatched 1:DNMT1 (SEQ ID NO: 291); AsCas12a unmatched 2:VEGFA (SEQ ID NO: 292-293); AsCas12a unmatched 2:EMX1 (SEQ ID NO: 294); AsCas12a unmatched 2:EMX1 (SEQ ID NO: 295); SpCas9 unmatched 7:VEGFA (SEQ ID NO: 296-311); SpCas9 unmatched 8:EMX1 (SEQ ID NO: 312-320); SpCas9 unmatched 9:GRIN2B (SEQ ID NO: 321-322); SpCas9 unmatched 10:TUBB (SEQ ID NO: 323-334); BhCas12b v4 unmatched 1:DNMT1-BvCas12b unmatched 8:DNMT1 (SEQ ID NO: 335-353); BhCas12b v4 unmatched 9:CXCR4-BvCas12b unmatched 14:VEGFA (SEQ ID NO: 354-367).
Figure 57B:
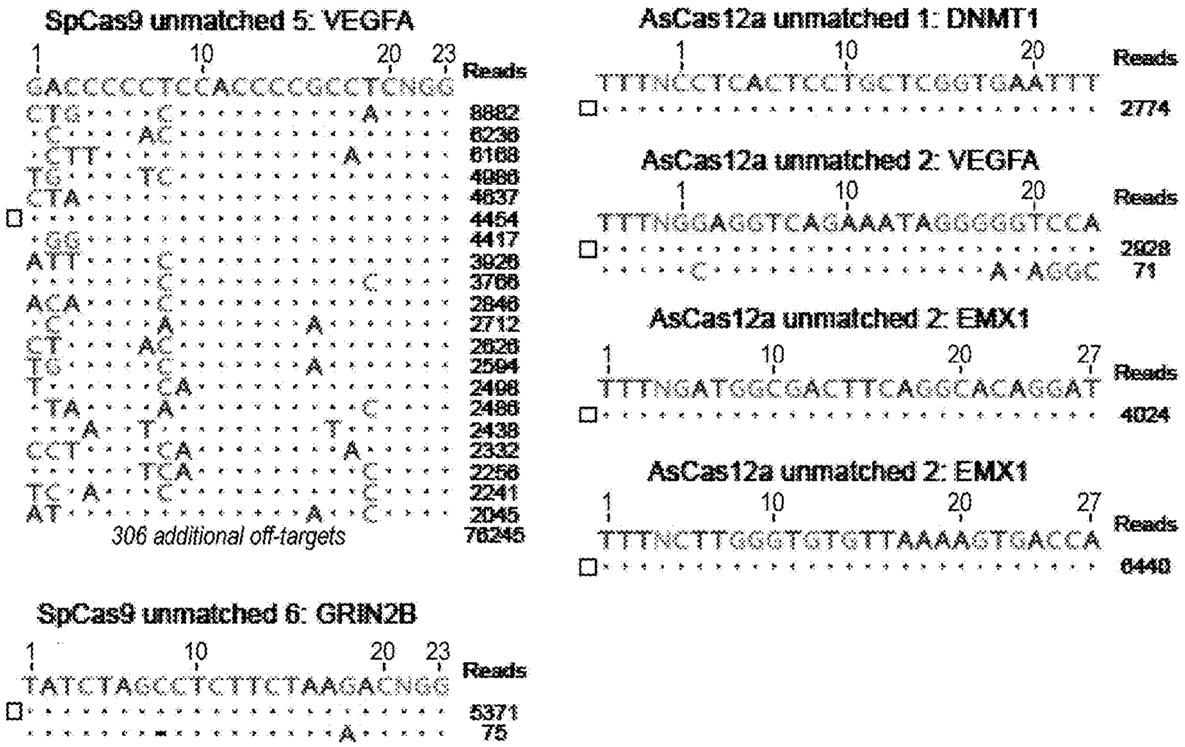
Figure 57C:
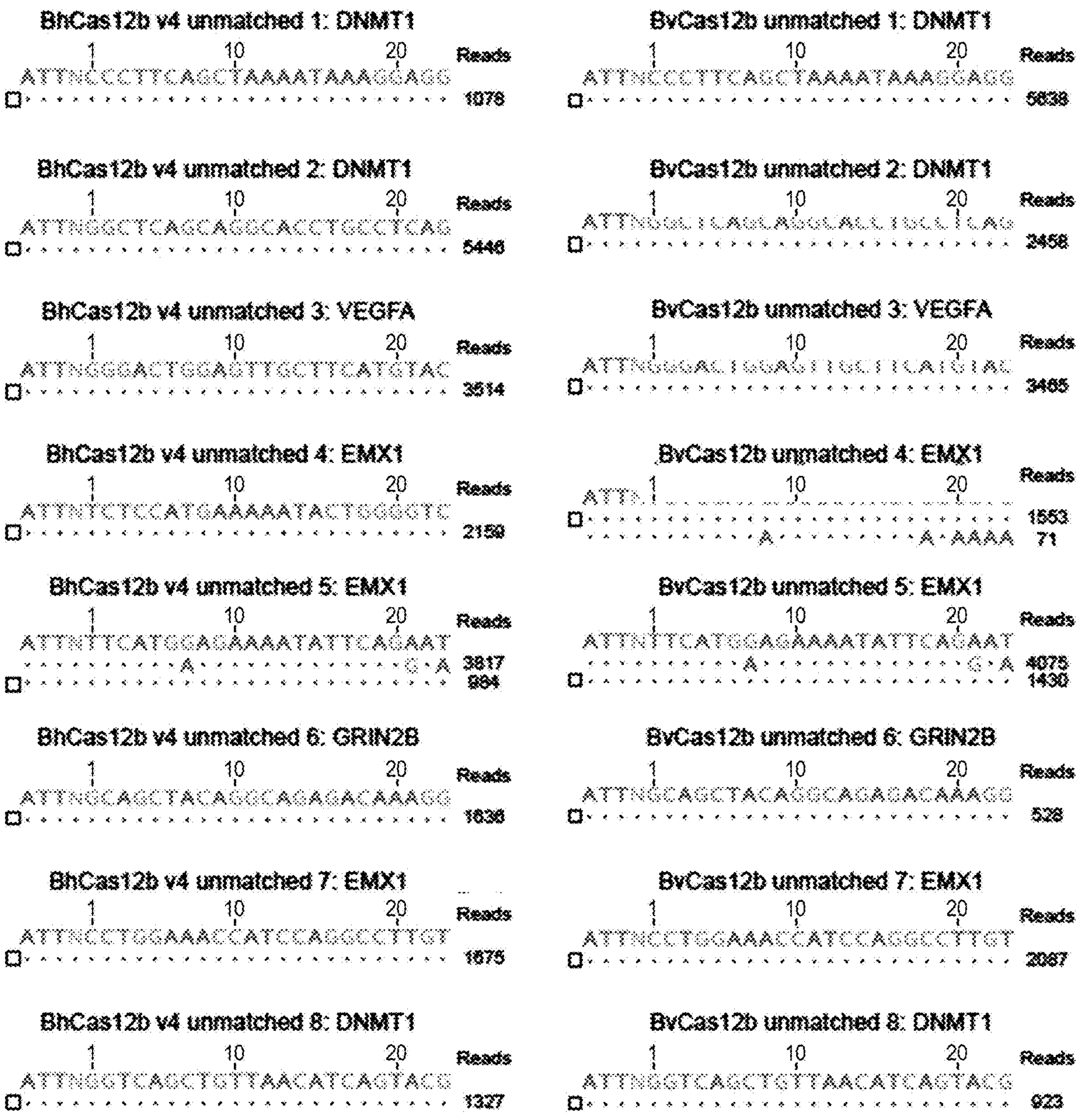
Figure 57D:
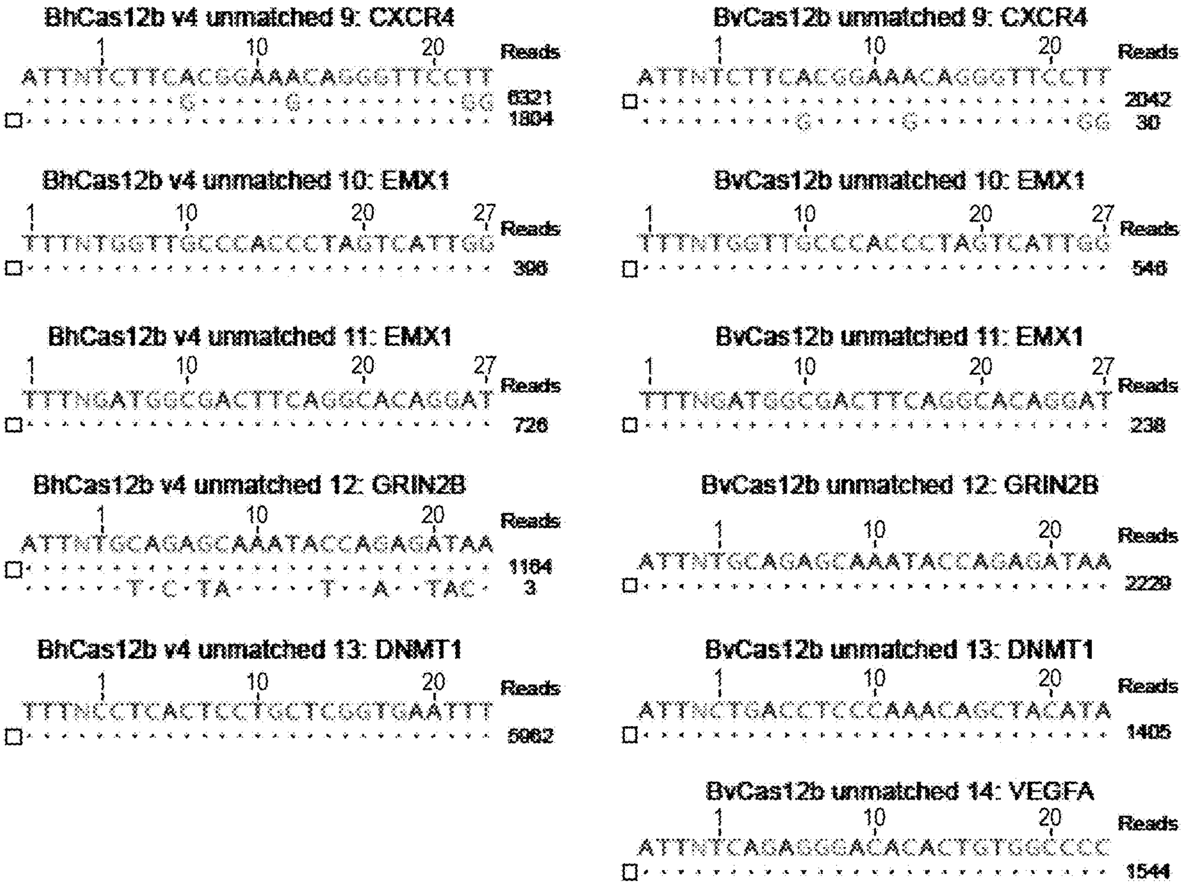

Applicants next sought to determine Cas12b specificity in cells. Applicants chose 9 target sites with comparable indel activity between different Cas nucleases (FIG. 47*a*) and performed Guide-Seq[19] analysis with these targets. Applicants did not detect any off-target sites for both Cas12b nucleases and AsCas12a, whereas SpCas9 led to prominent off-target cleavage in 6 of the 9 tested guides (FIG. 47*b*, FIG. 55), consistent with its known promiscuity[13,20]. For example, for Target 3, Applicants detected 101 insertion sites with SpCas9, with only 10% of reads mapping to the target site, but no off-target sites with either of the two Cas12b enzymes. Additional Guide-Seq experiments at unmatched sites detected significant off-target cleavage at only 2 of 14 sites for BhCas12b v4 and at 1 of 15 sites for BvCas12b (FIGS. 56*a*, 57). Consistent with these findings, Applicants observed limited indel activity with double mismatches between the guide RNA and target DNA in positions 1-20, and even a low tolerance for single mismatches (FIGS. 56*b* and 56*c*). These results agree with the reported specificity of AacCas12b in vitro[21] and provide a molecular mechanism for the low off-target activity observed in cells.

Here Applicants describe the first two members of the type-V CRISPR Cas12b family that are suitable for genome editing in human cells. Although many Cas12b nucleases show a strong preference for higher temperatures, our extensive screening led to the identification of members of this family that are highly active at 37° C. Furthermore, our engineering of BhCas12b led to a substantial increase in the efficiency of dsDNA cleavage and provides a framework for unlocking the potential of other Cas12b nucleases as genome editing tools. Both BhCas12b and BvCas12b are comparatively compact proteins (about 1100 amino acids each), and therefore, are suitable for efficient packaging into adeno-associated virus (AAV). In combination with their high target specificity, these Cas12b enzymes are promising new tools for in vivo genome editing.

Supplementary Information. Multiple Alignment of Cas12b Family Proteins

Sequences are denoted by accession numbers. The sequences from *Bacillus* sp V3-13 (WP 101661451.1) and *Bacillus hisashii* (WP_095142515.1) are highlighted in red. The 12 residues mutated in this work are shown by red highlighting in the *B. hisashii* (WP_095142515.1) sequence. The residues for which the substitutions substantially affected the DNA cleavage efficiency in the BhCas12 v4 mutant are rendered in yellow, with a red highlight.

Materials and Methods

Cas12b Sequence Alignment and Phylogenetic Tree Reconstruction

The alignment was constructed using MUSCLE program (v 3.7)[23]. Alignment was colored using bioinformatics.org/sms2/color_align_cons.htm server according to 100% consensus for the following groups of amino acids: GAVLI, FYW, CM, ST, KRH, DENQ, P. The positions with more than 50% gaps were discarded from the alignment used for tree reconstruction. The maximum-likelihood unrooted tree was generated using the PHYML program (v. 20120412)[24]. The same program was also used to compute bootstrap values, which are shown for selected branches.

Generation of Cas12b Expression Plasmids

Cas12b loci were synthesized and cloned into pACYC184 (Genewiz) for expression in *E. coli*. The Cas12b open reading frame (ORF) was codon optimized for human expression while upstream and downstream sequences flanking the ORF were left unchanged. CRISPR arrays were shorted to 3 direct repeats and the first endogenous spacer was replaced with the FnCpf1 protospacer 1 (FnPSP1) sequence

```
                              (SEQ ID NO: 591)
        (GAGAAGTCATTTAATAAGGCCACTGTTAAAA).
```

PAM Discovery

The identification of PAMs was performed as previously described[10]. Briefly, E. co/i cells expressing pACYC184-Cas12b systems were made competent with the Z-competent kit (Zymo Research). Cells expressing pACYC184-Cas12b or empty pACYC184 were transformed with a PAM library with randomized 8N sequence on the 5' side of the FnPSP1 target site and grown overnight for 16 h. Plasmid DNA was isolated, and the library sequenced using a 75-cycle NextSeq kit (Illumina). PAM representation in the library was determined using a custom Python script and compared between Cas12b and control with 2 independent replicates. Sequence motifs were generated using the Weblogo tool (weblogo.berkeley.edu). PAM wheels were generated using Krona plots (github.com/marbl/Krona/wiki)[22].

Bacterial RNA Sequencing

Small RNA-Seq was performed as previously described[1, 10]. Briefly, RNA was prepared from *E. coli* lysates using TRIzol followed by homogenization with a BeadBeater (BioSpec Products). rRNA was removed with the Ribo-Zero kit (Illumina) and libraries prepared using the NEBNext Small RNA Library Kit for Illumina (NEB). Libraries were sequenced with a 2×150 paired-end MiSeq run (Illumina) and the reads aligned and analyzed with Geneious R9 (Biomatters).

Purification of Cas12b Protein

Cas12b genes were cloned into bacterial expression plasmids (T7-TwinStrep-SUMO-NLS-Cas12b-NLS-3xHA) and expressed in BL21(DE3) cells (NEB #C2527H containing the pLysS-tRNA plasmid from Novagen #70956). Cells were grown in Terrific Broth to mid-log phase and the temperature lowered to 20° C. Expression was induced at 0.6 OD with 0.25 mM IPTG for 16-20 h before harvesting and freezing cells at −80° C. Cell paste was resuspended in lysis buffer (50 mM TRIS pH 8, 500 mM NaCl, 5% glycerol, 1 mM DTT) supplemented with EDTA-free complete protease inhibitor (Roche). Cells were lysed using a LM20 microfluidizer device (Microfluidics) and cleared lysate bound to Strep-Tactin Superflow Plus resin (Qiagen). Resin was washed using lysis buffer and Cas12b protein eluted with lysis buffer supplemented with 5 mM desthiobiotin. The TwinStrep-SUMO tag was removed by overnight digest at 4° C. with homemade SUMO protease Ulp1 at a 1:100 weight ratio of protease to Cas12b. Cleaved Cas12b protein was diluted to 200 mM NaCl and purified using a HiTrap Heparin HP column on an AKTA Pure 25 L (GE Healthcare Life Sciences) with a 200 mM-1M NaCl gradient. Fractions containing Cas12b were pooled and concentrated and loaded onto a Superdex 200 Increase column (GE Healthcare Life Sciences) with a final storage buffer of 25 mM TRIS pH 8, 500 mM NaCl, 5% glycerol, 1 mM DTT. Puirified Cas12b protein was concentrated to 5 uM or 73 uM stocks and flash-frozen in liquid nitrogen before storage at −80° C.

In Vitro RNA Synthesis

All RNA was generated by annealing a DNA oligonucleotide containing the reverse complement of the desired RNA with a short T7 oligonucleotide. In vitro transcription was performed using the HiScribe T7 High Yield RNA synthesis kit (NEB) at 37° C. for 8-12 h and RNA purified using Agencourt AMPure RNA Clean beads (Beckman Coulter).

In Vitro Cleavage Reactions

DNA substrates were generated by PCR amplification of pUC19 plasmids containing the FnPSP1 target site. Typical reactions contained 100 ng of DNA substrate, 250 nM of Cas12b protein, 500 nM of RNA and a final 1× reaction buffer of 20 mM TRIS pH 6.5, 6 mM MgCl2. Reactions were quenched with 20 mM EDTA, RNA digested with 5 ug RNAse A (Qiagen) at 37° for 5 min, and DNA products purified using a PCR cleanup kit (Qiagen). Reactions were run on Novex 10% TBE PAGE gels in 1×TBE buffer (Thermo Fisher Scientific) and stained with SYBR Gold (Thermo Fisher Scientific). Labelled DNA substrates were generated with IR700 and IR800 conjugated DNA oligonucleotides (IDT). For denaturing gels, DNA was mixed with an equal volume of 100% formamide followed by heat denaturation at 95° C. for 5 min. Products were separated on Novex Urea-PAGE gels (Thermo Fisher Scientific) in 1×TBE buffer pre-heated to 60° C. and were imaged on an Odyssey CLx device (LI-COR). Where applicable, quantitation of DNA cleavage or nicking was determined by the formula, $100\times(1-\mathrm{sqrt}(1-(b+c)/(a+b+c)))$, where a is the integrated intensity of the undigested product and b and c are the integrated intensities of each cleavage or nicking product.

Mammalian Expression Constructs and Mutagenesis

Cas12b genes were amplified from their corresponding pACYC184 plasmids and cloned into pCDNA3.1 containing N- and C-terminal NLS tags and a C-terminal 3xHA tag. Guide expression plasmids were generated by cloning sgRNA scaffolds containing two inverted BsmBI Type IIS restriction sites behind the U6 promoter. Guides were cloned into the scaffolds by Golden Gate assembly with two annealed complementary oligonucleotides. Unless noted, all guides were 23-nt in length. Desired Cas12b mutations were ordered on oligonucleotides to generate two overlapping Cas12b PCR products which were assembled using Gibson Assembly Master Mix (NEB). The guide sequences used are shown in Table 31 below.

TABLE 31

| Gene | Target | 5' PAM | Sequence |
|---|---|---|---|
| DNMT1 | 1 | GTTCT | AGACCCAGAGGCTCAAGTGAGCA (SEQ ID NO: 592) |
| DNMT1 | 2 | ATTTT | AGCTGAAGGGAAATAAAAGGAAA (SEQ ID NO: 593) |
| VEGFA | 3 | ATTCT | TCTCCCCTGGGAAGCATCCCTGG (SEQ ID NO: 594) |
| ENDO | 4 | ATTTT | TCATGGAGAAAATATTCAGAATC (SEQ ID NO: 595) |
| DNMT1 | 5 | TTTC | CCTCACTCCTGCTCGGTGAATTT (SEQ ID NO: 596) |
| DNMT1 | 6 | TTTG | AGGAGTGTTCAGTCTCCGTGAAC (SEQ ID NO: 597) |
| VEGFA | 7 | TTTG | GGAGGTCAGAAATAGGGGGTCCA (SEQ ID NO: 598) |
| VEGFA | 8 | TTTC | CAAAGCCCATTCCCTCTTTAGCC (SEQ ID NO: 599) |
| DNMT1 | 9 | ATTT | CCCTTCAGCTAAAATAAAGGAGG (SEQ ID NO: 600) |
| VEGFA | 10 | ATTC | TTCTCCCCTGGGAAGCATCCCTG (SEQ ID NO: 601) |
| GRIN2B | 11 | ATTC | TGCAGAGCAAATACCAGAGATAA (SEQ ID NO: 602) |
| PDCD1 | 12 | ATTG | CGCCGGGCCCTGACCACGCTCAT (SEQ ID NO: 603) |
| CXCR4 | 13 | ATTC | CCGACTTCATCTTTGCCAACGTC (SEQ ID NO: 604) |
| ENDO | 14 | ATTT | TAGAGCACTGGCATGGGGATGGG (SEQ ID NO: 605) |
| ENDO | 15 | ATTC | TTGCTCCAGAGGCCCCCCTTGGG (SEQ ID NO: 606) |
| DNMT1 | 16 | ATTC | CTGGTGCCAGAAACAGGGGTGAC (SEQ ID NO: 607) |
| CXCR4 | 17 | ATTC | TGGGCTTCAAGCAACTTGTAGTG (SEQ ID NO: 608) |
| CXCR4 | 18 | ATTT | TGTAATTGGTTCTACCAAAGAAG (SEQ ID NO: 609) |
| CXCR4 | 19 | ATTT | AGAGGCGGAGGGCGGCGTGCCTG (SEQ ID NO: 610) |
| GRIN2B | 20 | TTTC | CTTCAGCCCAAGAACAGTACAAG (SEQ ID NO: 611) |
| CXCR4 | 21 | TTTC | TCTGTGAGTCGAGGAGAAACGAC (SEQ ID NO: 612) |
| HPRT1 | 22 | TTTC | CTTGGGTGTGTTAAAAGTGACCA (SEQ ID NO: 613) |
| DNMT1 | 23 | - | TCACTCCTGCTCGGTGAATT (SEQ ID NO: 614) |
| ENDO | 24 | - | GCTACAGGCAGAGACAAAGG (SEQ ID NO: 615) |
| VEGFA | 25 | - | AGGTCAGAAATAGGGGGTCC (SEQ ID NO: 616) |
| VEGFA | 26 | - | CAGGCTGTGAACCTTGGTGG (SEQ ID NO: 617) |

TABLE 31-continued

| Gene | Target | 5' PAM | Sequence |
|---|---|---|---|
| VEGFA | 27 | - | GACCCCCTCCACCCCGCCTC (SEQ ID NO: 618) |
| GRIN2B | 28 | - | GTATCTAGCCTCTTCTAAGAC (SEQ ID NO: 619) |
| VEGFA | 29 | - | TCTCCCCTGGGAAGCATCCC (SEQ ID NO: 620) |
| ENDO | 30 | - | GAGTCCGAGCAGAAGAAGAA (SEQ ID NO: 621) |
| TUBB | 31 | - | TTTTGGGAGTAAGAAAAGGT (SEQ ID NO: 622) |
| VEGFA | 32 | - | AGTGTCCAGGGATGCTTCCC (SEQ ID NO: 623) |
| DNMT1 | 33 | TTTC | CCTCACTCCTGCTCGGTGAATTT (SEQ ID NO: 624) |
| VEGFA | 34 | TTTG | GGAGGTCAGAAATAGGGGGTCCA (SEQ ID NO: 625) |
| ENDO | 35 | TTTG | GATGGCGACTTCAGGCACAGGAT (SEQ ID NO: 626) |
| ENDO | 36 | TTTG | GGAAGTGTCCAGGGATGCTTCCC (SEQ ID NO: 627) |
| DNMT1 | 37 | ATTT | CCCTTCAGCTAAAATAAAGGAGG (SEQ ID NO: 628) |
| DNMT1 | 38 | ATTT | GGCTCAGCAGGCACCTGCCTCAG (SEQ ID NO: 629) |
| VEGFA | 39 | ATTT | GGGACTGGAGTTGCTTCATGTAC (SEQ ID NO: 630) |
| ENDO | 40 | ATTT | TCTCCATGAAAAATACTGGGGTC (SEQ ID NO: 631) |
| ENDO | 41 | ATTT | TTCATGGAGAAAATATTCAGAAT (SEQ ID NO: 632) |
| GRIN2B | 42 | ATTG | GCAGCTACAGGCAGAGACAAAGG (SEQ ID NO: 633) |
| ENDO | 43 | ATTT | CCTGGAAACCATCCAGGCCTTGT (SEQ ID NO: 634) |
| DNMT1 | 44 | ATTG | GGTCAGCTGTTAACATCAGTACG (SEQ ID NO: 635) |
| CXCR4 | 45 | ATTT | TCTTCACGGAAACAGGGTTCCTT (SEQ ID NO: 636) |
| ENDO | 46 | TTTG | TGGTTGCCCACCCTAGTCATTGG (SEQ ID NO: 637) |
| ENDO | 47 | TTTG | GATGGCGACTTCAGGCACAGGAT (SEQ ID NO: 638) |
| DNMT1 | 49 | TTTC | CCTCACTCCTGCTCGGTGAATTT (SEQ ID NO: 639) |
| VEGFA | 50 | TTTG | GGAAGTGTCCAGGGATGCTTCCC (SEQ ID NO: 640) |
| DNMT1 | 51 | ATTT | GGCTCAGCAGGCACCTGCCTCAG (SEQ ID NO: 641) |
| ENDO | 52 | ATTT | TTCATGGAGAAAATATTCAGAAT (SEQ ID NO: 642) |
| VEGFA | 53 | ATTT | CTGACCTCCCAAACAGCTACATA (SEQ ID NO: 643) |

Cell Culture and Transfections

HEK293T cells (ATCC) were cultured in Dulbecco's Modified Eagle Medium with high glucose, sodium pyruvate, and GlutaMAX (Thermo Fisher Scientific), 1× penicillin-streptomycin (Thermo Fisher Scientific), and 10% fetal bovine serum (Seradigm). Cells were maintained at a confluency below 90% and tested negative for *mycoplasma* using the MycoAlert detection kit (Lonza). For indel analysis, 96-well plates were seeded with 17,500 cells/well approximately 16 hours before transfection for a confluency of approximately 7500 at the time of transfection. Each 96-well was transfected with 100 ng of nuclease expressing plasmid and 100 ng of guide plasmid in 20 uL of Opti-MEM (Thermo Fisher Scientific) with 0.6 uL of TransIt-LT1 transfection reagent (Mirus). Cells were harvested 72 h post-transfection with QuickExtract DNA extraction solution (Lucigen).

For HTDR experiments, 100 ng of nuclease, 100 ng of guide and 100 ng of ssODNs were transfected per 96-well with 0.9 uL of TransIt-LT1 transfection reagent (Mirus). ssODNs were ordered as Ultramer DNA oligonucleotides (IDT) and contained 3 phosphorothioate modification on each end.

Deep Sequencing of Indel Mutations

Targeted indel analysis was performed by amplifying genomic regions of interest with NEBNext High-Fidelity 2×PCR Master Mix (NEB) using a two-round PCR strategy to add Illumina P5 adaptors and unique sample-specific barcodes. Libraries were sequenced with 1×200 cycle MiSeq runs (Illumina). Indel rates were measured using Outknocker 2[25]. (outknocker.org/outknocker2.htm).

Off-Target Analysis

Off-target cleavage sites were identified using Guide-Seq with modified library preparation. Briefly, cells were transfected in 96-well plates with 75 ng nuclease plasmid, 25 ng guide plasmid, and 100 ng annealed dsDNA oligos in 50 uL Opti-MEM with 0.5 uL GeneJuice Transfection Reagent (Millipore).

```
F:
                                          (SEQ ID NO: 644)
/5phos/G*T*TGTGAGCAAGGGCGAGGAGGATAACGCCTCTCTCCCAGC

GACT*A*T

R:
                                          (SEQ ID NO: 645)
/5phos/A*T*AGTCGCTGGGAGAGAGGCGTTATCCTCCTCGCCCTTGCT

CACA*A*C
```

Cells were harvested after 72 hr and 10 wells were pooled for each experiment. 1E6 cells were lysed and genomic DNA was tagmented with Tn5 followed by purification using a plasmid mini-prep column (Qiagen). Libraries were prepared using two rounds of PCR amplification with KOD Hot Start DNA Polymerase (Millipore) using a Tn5 adapter-specific primer and nested primers within the DNA donor. Libraries were sequenced with a 75-cycle NextSeq kit (Illumina). Reads were mapped to the human genome (hg38) using BrowserGenome.org[26].

T Cells Culture

Human CD4+ T cells (STEMCELL Technologies) were cultured in RMPI 1640 (Glutamax Supplement, Gibco) supplemented with 5 mM HEPES, pH 8.0 (Gibco), 50 μg/mL penicillin/streptomycin (Gibco), 50 uM 2-mercaptoethanol (Sigma-Aldrich), 5 mM MEM non-essential amino acids (Gibco), 5 mM sodium pyruvate (Gibco) and 10% FBS (Seradigm). Cells were activated for 5-7 days post thaw by plating every two days on dishes coated with 10 μg/mL of anti-CD3 (UCHT1, eBioscience, Invitrogen) and anti-CD28 (CD28.2, eBioscience, Invitrogen) monoclonal antibodies.

RNP Complexing and Delivery

BhCas12b sgRNA were synthesized with three 2'O-methyl modifications at 3' end (Integrated DNA Technologies). RNPs were formed by incubating 10 mg/mL protein with 50 uM annealed RNA at a 1:1 molar ratio at 37° C. for 15 min. RNPs were stored on ice until electroporation.

Cells were electroporated using the Amaxa P3 Primary Cell 4D-Nucleofector X Kit (Lonza). Per reaction, $3\times10^5$ stimulated CD4+ T cells were pelleted and resuspended in 20 uL P3 buffer. 4.5 uM Cas9 or Cas12b protein, precomplexed with crRNA and tracrRNA, was added and the mixture transferred to the electroporation cuvette. Cells were electroporated using program EH-115 on the Amaxa 4D-Nucleofector (Lonza). 80 μL of prewarmed complete media was immediately added to the cells post-pulse and the cells were incubated at 37 C for 30 minutes to recover in the cuvette. After recovery, 50 μL of the cell suspension was added to 50 μL of complete medium plus 80 IU/mL IL-2 (STEMCELL Technologies) for a final concentration of 40 IU/mL IL-2. The cells were plated on CD3/CD28 precoated 96-well plates. Cells were harvested after 48 hours for indel analysis.

REFERENCES

1 Shmakov, S. et al. Discovery and Functional Characterization of Diverse Class 2 CRISPR-Cas Systems. *Mol Cell* 60, 385-397, doi:10.1016/j.molcel.2015.10.008 (2015).

2 Seuylemezian, A., Cooper, K., Schubert, W. & Vaishampayan, P. Draft Genome Sequences of 12 Dry-Heat-Resistant *Bacillus* Strains Isolated from the Cleanrooms Where the Viking Spacecraft Were Assembled. *Genome announcements* 6, doi:10.1128/genomeA.00094-18 (2018).

3 Knott, G. J. & Doudna, J. A. CRISPR-Cas guides the future of genetic engineering. *Science* 361, 866-869, doi:10.1126/science.aat5011 (2018).

4 Hsu, P. D., Lander, E. S. & Zhang, F. Development and Applications of CRISPR-Cas9 for Genome Engineering. *Cell* 157, 1262-1278, doi:10.1016/j.cell.2014.05.010 (2014).

5 Cong, L. et al. Multiplex Genome Engineering Using CRISPR/Cas Systems. *Science* 339, 819-823, doi: 10.1126/science.1231143 (2013).

6 Mali, P. et al. RNA-Guided Human Genome Engineering via Cas9. *Science* 339, 823-826, doi:10.1126/science.1232033 (2013).

7 Deltcheva, E. et al. CRISPR RNA maturation by trans-encoded small RNA and host factor RNase III. *Nature* 471, 602-607, doi:10.1038/nature09886 (2011).

8 Bolotin, A., Ouinquis, B., Sorokin, A. & Ehrlich, S. D. Clustered regularly interspaced short palindrome repeats (CRISPRs) have spacers of extrachromosomal origin. *Microbiol-Sgm* 151, 2551-2561, doi:10.1099/mic.0.28048-0 (2005).

9 Makarova, K. S., Grishin, N. V., Shabalina, S. A., Wolf, Y. I. & Koonin, E. V. A putative RNA-interference-based immune system in prokaryotes: computational analysis of the predicted enzymatic machinery, functional analogies with eukaryotic RNAi, and hypothetical mechanisms of action. *Biol Direct* 1, doi:Artn 710.1186/1745-6150-1-7 (2006).

10 Zetsche, B. et al. Cpf1 is a single RNA-guided endonuclease of a class 2 CRISPR-Cas system. *Cell* 163, 759-771, doi:10.1016/j.cell.2015.09.038 (2015).

11 Shmakov, S. et al. Diversity and evolution of class 2 CRISPR-Cas systems. *Nat Rev Microbiol* 15, 169-182, doi:10.1038/nrmicro.2016.184 (2017).

12 Cox, D. B. T. et al. RNA editing with CRISPR-Cas13. *Science* 358, 1019-1027, doi:10.1126/science.aaq0180 (2017).

13 Hsu, P. D. et al. DNA targeting specificity of RNA-guided Cas9 nucleases. *Nat Biotechnol* 31, 827-+, doi:10.1038/nbt.2647 (2013).

14 Yang, H., Gao, P., Rajashankar, K. R. & Patel, D. J. PAM-Dependent Target DNA Recognition and Cleavage by C2c1 CRISPR-Cas Endonuclease. *Cell* 167, 1814-1828 e1812, doi:10.1016/j.cell.2016.11.053 (2016).

15 Wu, D., Guan, X., Zhu, Y., Ren, K. & Huang, Z. Structural basis of stringent PAM recognition by CRISPR-C2c1 in complex with sgRNA. *Cell Res* 27, 705-708, doi:10.1038/cr.2017.46 (2017).

16 Suzuki, M. A framework for the DNA-protein recognition code of the probe helix in transcription factors: the chemical and stereochemical rules. *Structure* (London, England 1993) 2, 317-326 (1994).

17 Mavromatis, K., Tsigos, I., Tzanodaskalaki, M., Kokkinidis, M. & Bouriotis, V. Exploring the role of a glycine cluster in cold adaptation of an alkaline phosphatase. *Eur J Biochem* 269, 2330-2335 (2002).

18 Saavedra, H. G., Wrabl, J. O., Anderson, J. A., Li, J. & Hilser, V. J. Dynamic allostery can drive cold adaptation in enzymes. Nature 558, 324-+, doi:10.1038/s41586-018-0183-2 (2018).

19 Tsai, S. Q. et al. GUIDE-seq enables genome-wide profiling of off-target cleavage by CRISPR-Cas nucleases. *Nat Biotechnol* 33, 187-197, doi:10.1038/nbt.3117 (2015).

20 Fu, Y. F. et al. High-frequency off-target mutagenesis induced by CRISPR-Cas nucleases in human cells. *Nat Biotechnol* 31, 822-+, doi:10.1038/nbt.2623 (2013).

21 Liu, L. et al. C2c1-sgRNA Complex Structure Reveals RNA-Guided DNA Cleavage Mechanism. *Mol Cell* 65, 310-322, doi:10.1016/j.molcel.2016.11.040 (2017).

22 Leenay, R. T. et al. Identifying and Visualizing Functional PAM Diversity across CRISPR-Cas Systems. *Molecular Cell* 62, 137-147, doi:10.1016/j.molcel.2016.02.031 (2016).

23 Edgar, R. C. MUSCLE: multiple sequence alignment with high accuracy and high throughput. *Nucleic Acids Res* 32, 1792-1797, doi:10.1093/nar/gkh340 (2004).

24 Guindon, S. & Gascuel, O. A simple, fast, and accurate algorithm to estimate large phylogenies by maximum likelihood. *Syst Biol* 52, 696-704 (2003).

25 Schmid-Burgk, J. L. et al. OutKnocker: a web tool for rapid and simple genotyping of designer nuclease edited cell lines. *Genome Res* 24, 1719-1723, doi:10.1101/gr.176701.114 (2014).

26 Schmid-Burgk, J. L. & Hornung, V. BrowserGenome.org: web-based RNA-seq data analysis and visualization. *Nat Methods* 12, 1001, doi:10.1038/nmeth.3615 (2015).

Jinek, M. et al. A Programmable Dual-RNA-Guided DNA Endonuclease in Adaptive Bacterial Immunity. *Science* 337, 816-821 (2012).

Teng, F. et al. Repurposing CRISPR-Cas12b for mammalian genome engineering. *Cell Discov* 4, 63 (2018).

Example 26

Figure 58:
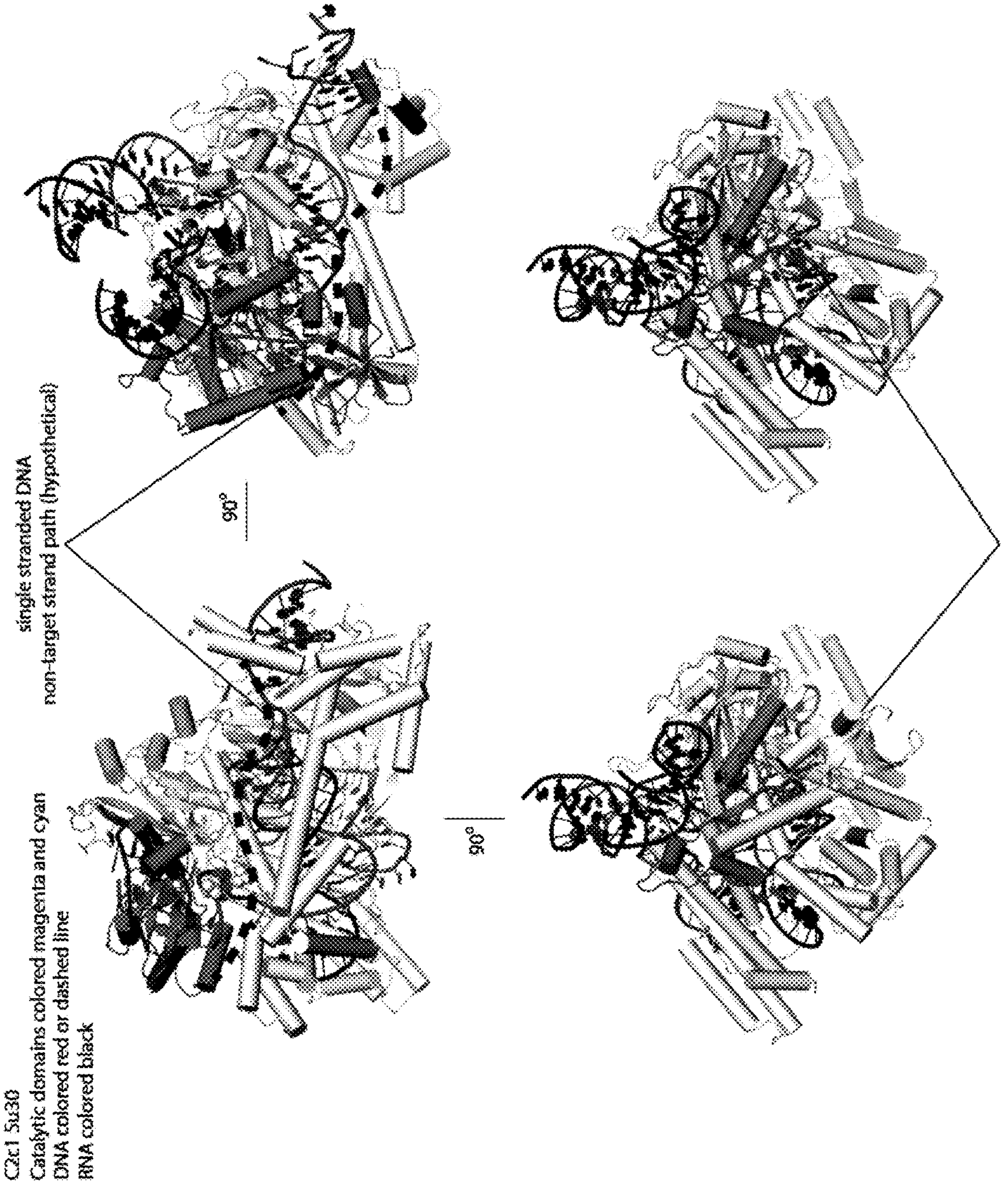
FIG. 58. Shows a structurally predicted ssDNA path in Cas12 (based on PDB structure 5U30).

FIG. 58 shows Cas12b (C2c1) structure (based on PDB structure 5U30). The figure shows the structurally predicted ssDNA path, and a domain that may be removed, in part or in whole, to access additional ssDNA.

Example 27

Mutations in ADAR affecting ADAR activity were screened using yeast screening. The screen was performed in multiple rounds. Each round of screening yielded a set of candidate mutations. The candidate mutations were then validated in mammalian cells. The top-performing mutations were added to the last version of mutations and re-screened. The mutations screened in 10 rounds are shown in Table 32 below. The mutant identified in round n was designated as "RESCUE vn-1." As discussed herein RESCUE refer to mutations that convert adenosine deaminase activity to cytidine deaminase activity.

TABLE 32

| RESCUE Round | ADAR mutations | Plasmid |
|---|---|---|
| RESCUEv0 | E488Q | pAB0048 |
| RESCUEv1 | E488Q, V351G | pAB0359 |
| RESCUEv2 | E488Q, V351G, S486A | pAB1188 |
| RESCUEv3 | E488Q, V351G, S486A, T375S | pAB0642 |
| RESCUEv4 | E488Q, V351G, S486A, T375S, S370C, | pAB1072 |
| RESCUEv5 | E488Q, V351G, S486A, T375S, S370C, P462A | pAB1135 |
| RESCUEv6 | E488Q, V351G, S486A, T375S, S370C, P462A, N597I | pAB1146 |
| RESCUEv7 | E488Q, V351G, S486A, T375S, S370C, P462A, N597I, L332I | pAB1194 |
| RESCUEv8 | E488Q, V351G, S486A, T375S, S370C, P462A, N597I, L332I, I398V | pAB1220 |
| RESCUEv9 | E488Q, V351G, S486A, T375S, S370C, P462A, N597I, L332I, I398V, K3501 | pAB1327 |

Figure 59:
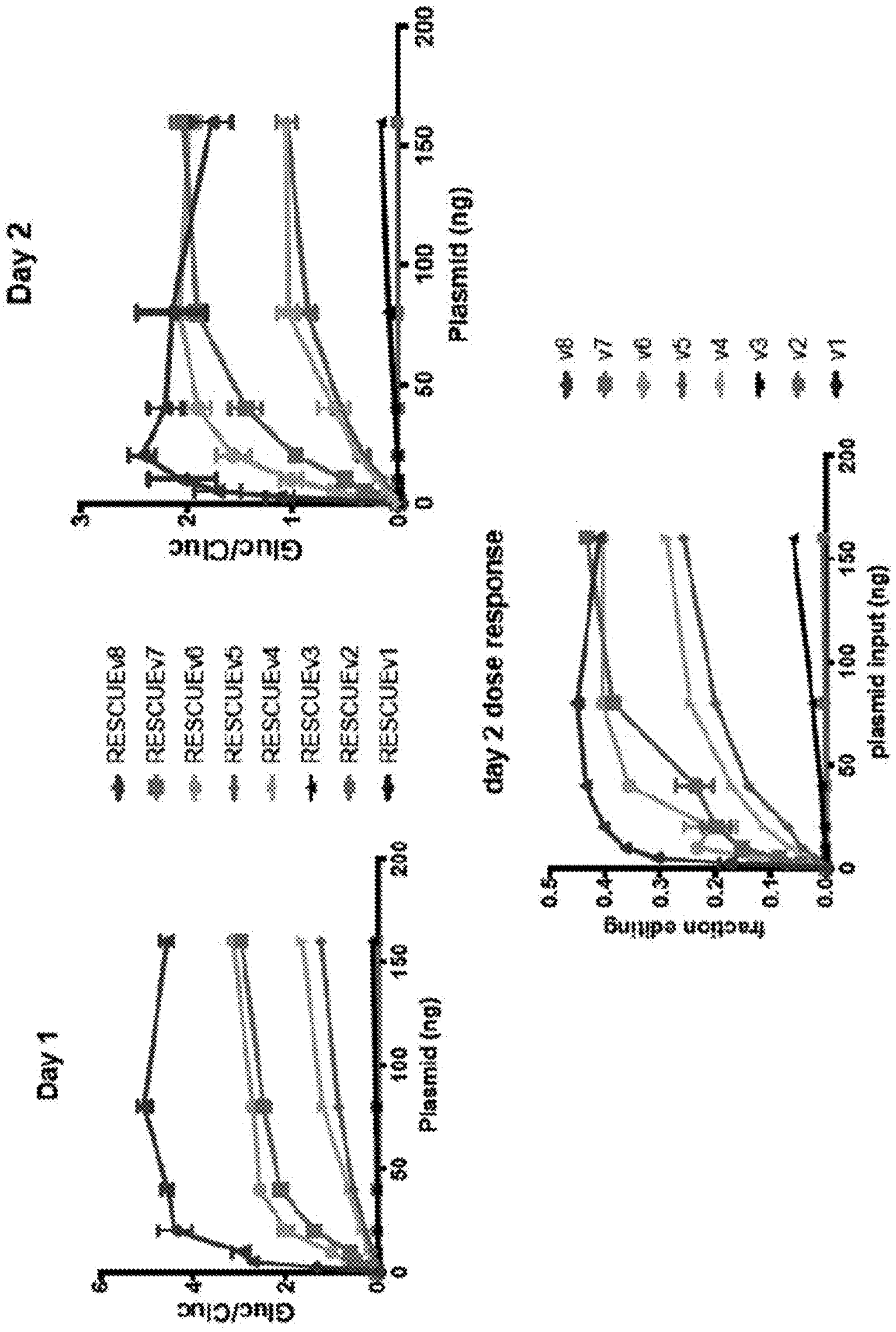
FIG. 59 shows dose responses of the RESCUE mutants tested on T motif.
Figure 60:
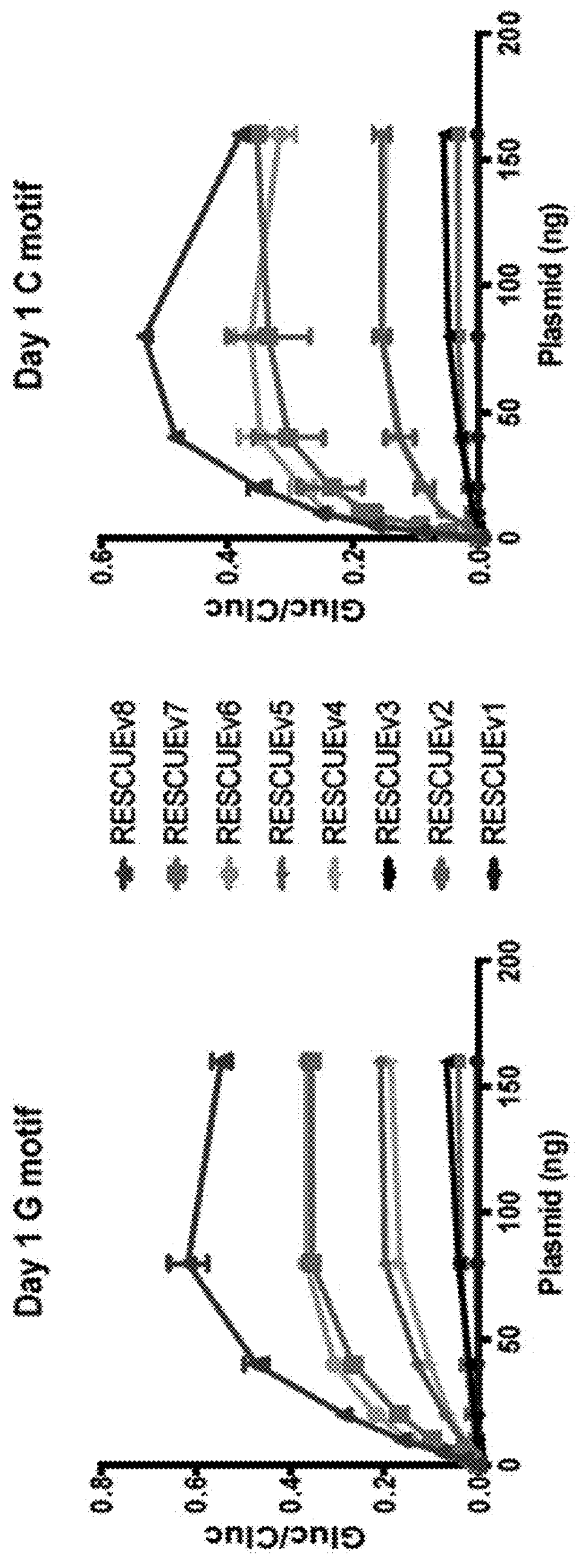
FIG. 60 shows dose responses of the RESCUE mutants tested on the C and G motif.
Figure 61:
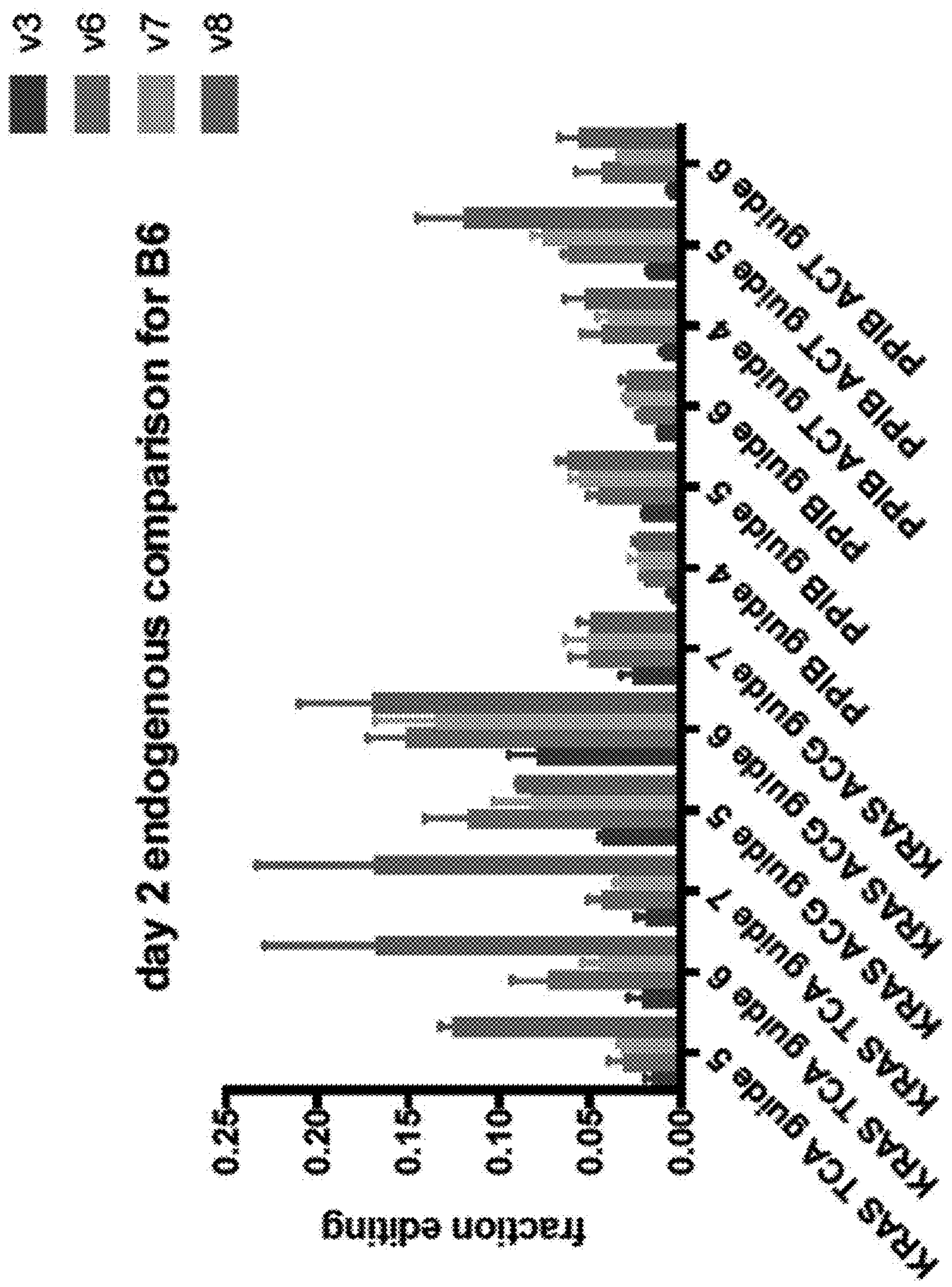
FIGS. 61 and 62 show endogenous targeting with RESCUE v3, v6, v7, and v8.
Figure 62:
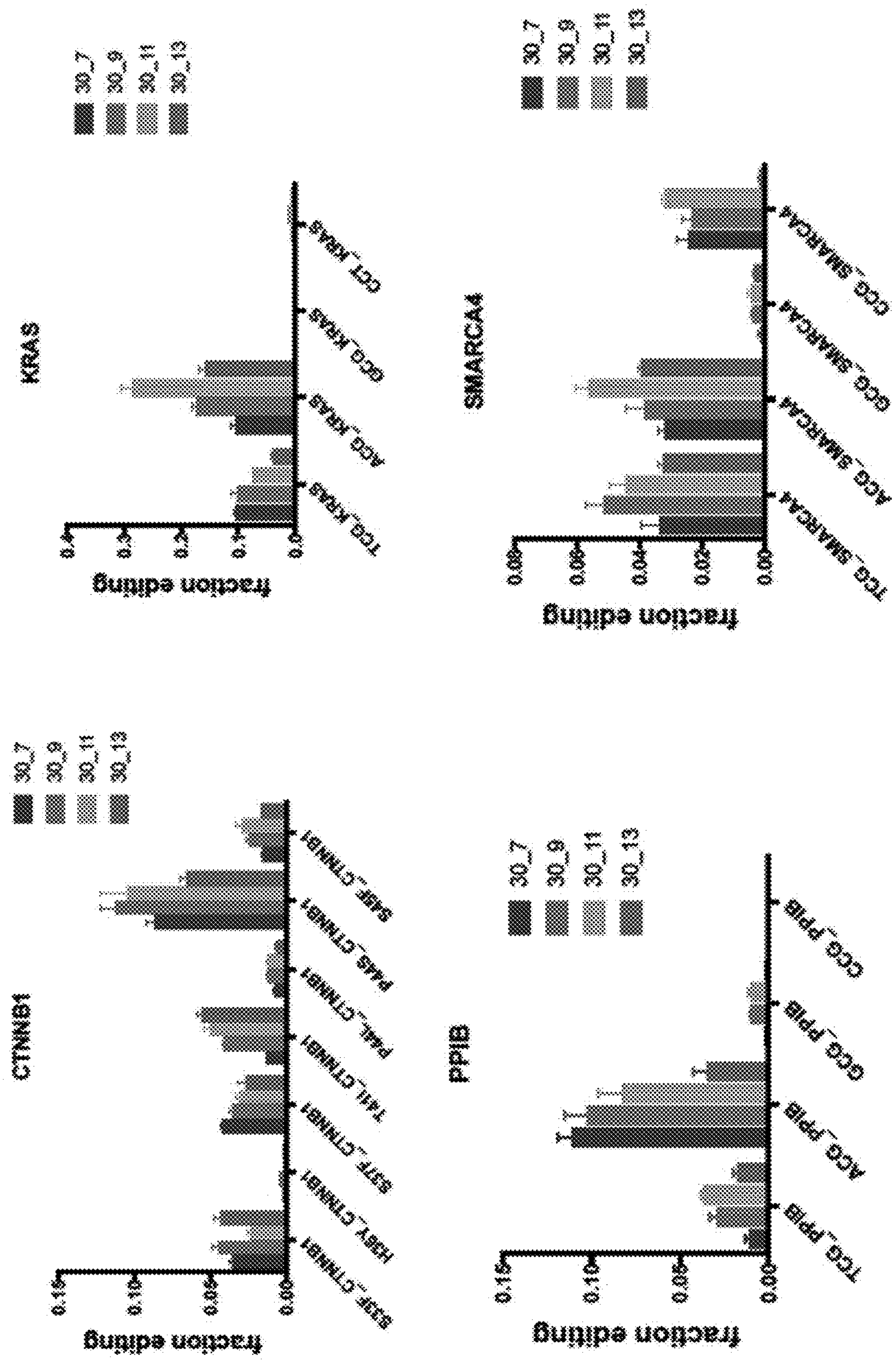

Dose responses of the RESCUE mutants were tested on the T motif (FIG. 59) and C and G motifs (FIG. 60). Endogenous targeting with RESCUE v3, v6, v7, and v8 was tested (FIGS. 61 and 62).

Figure 63:
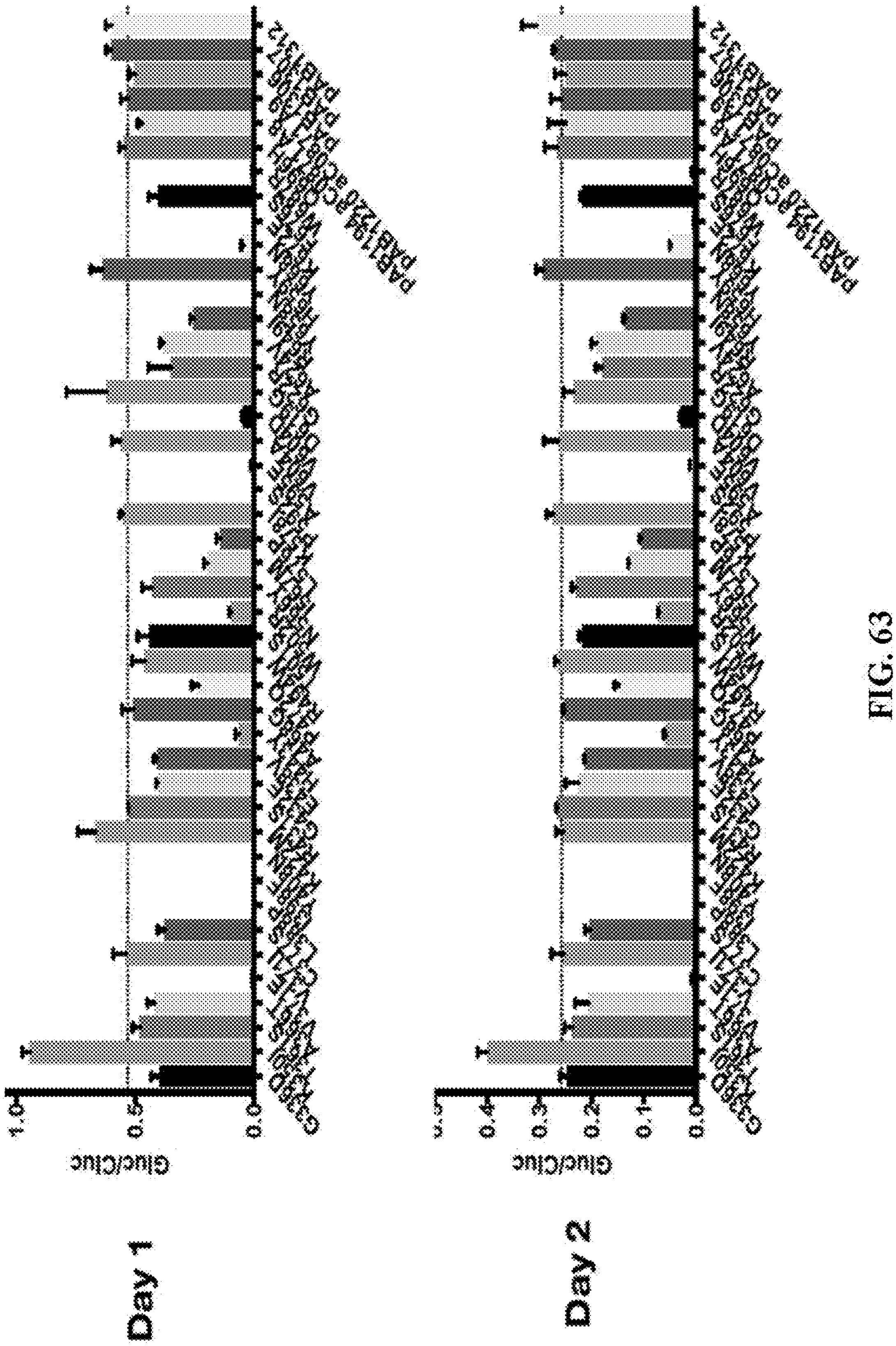
FIG. 63 shows screening for mutations for RESCUE v9.
Figure 64:
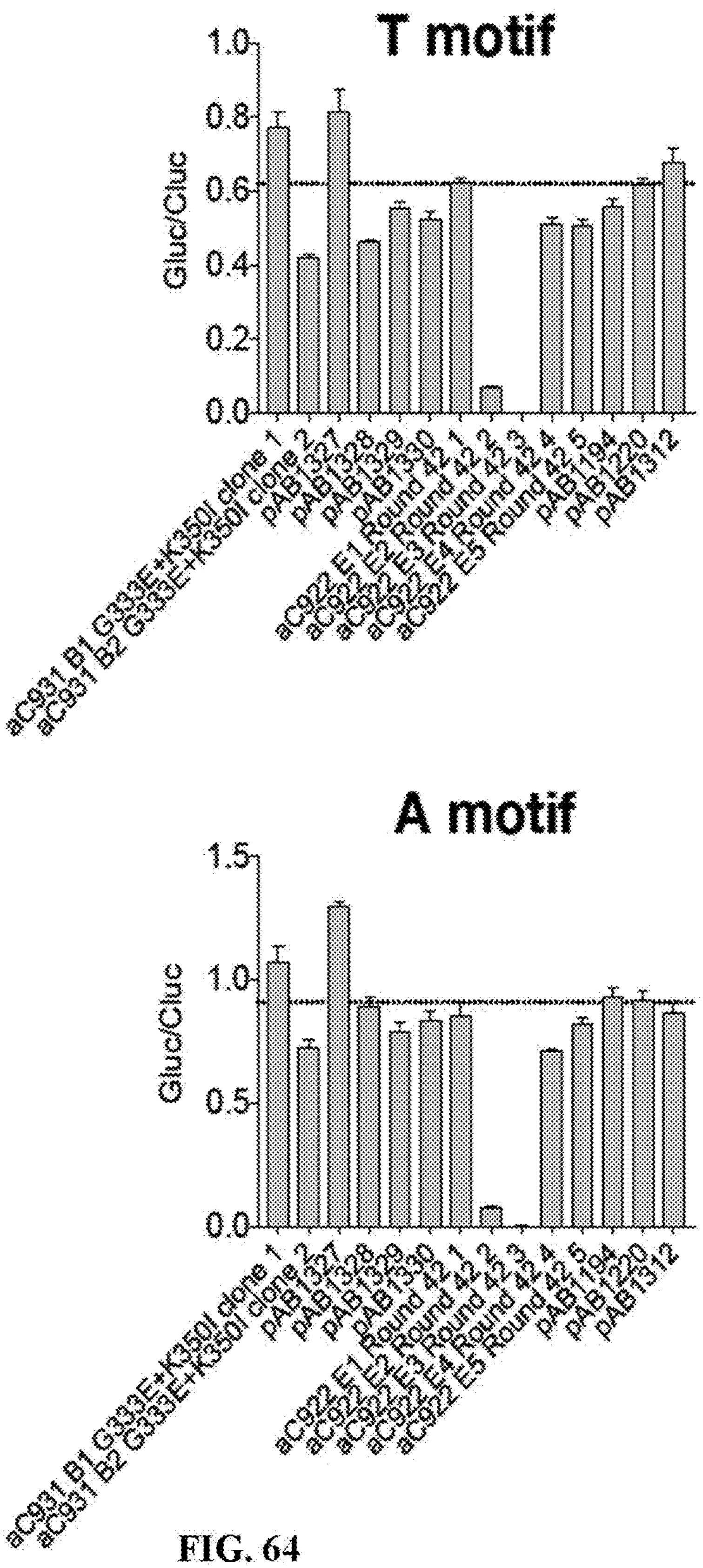
FIG. 64 shows potential mutations for RESCUE v9.
Figure 65:
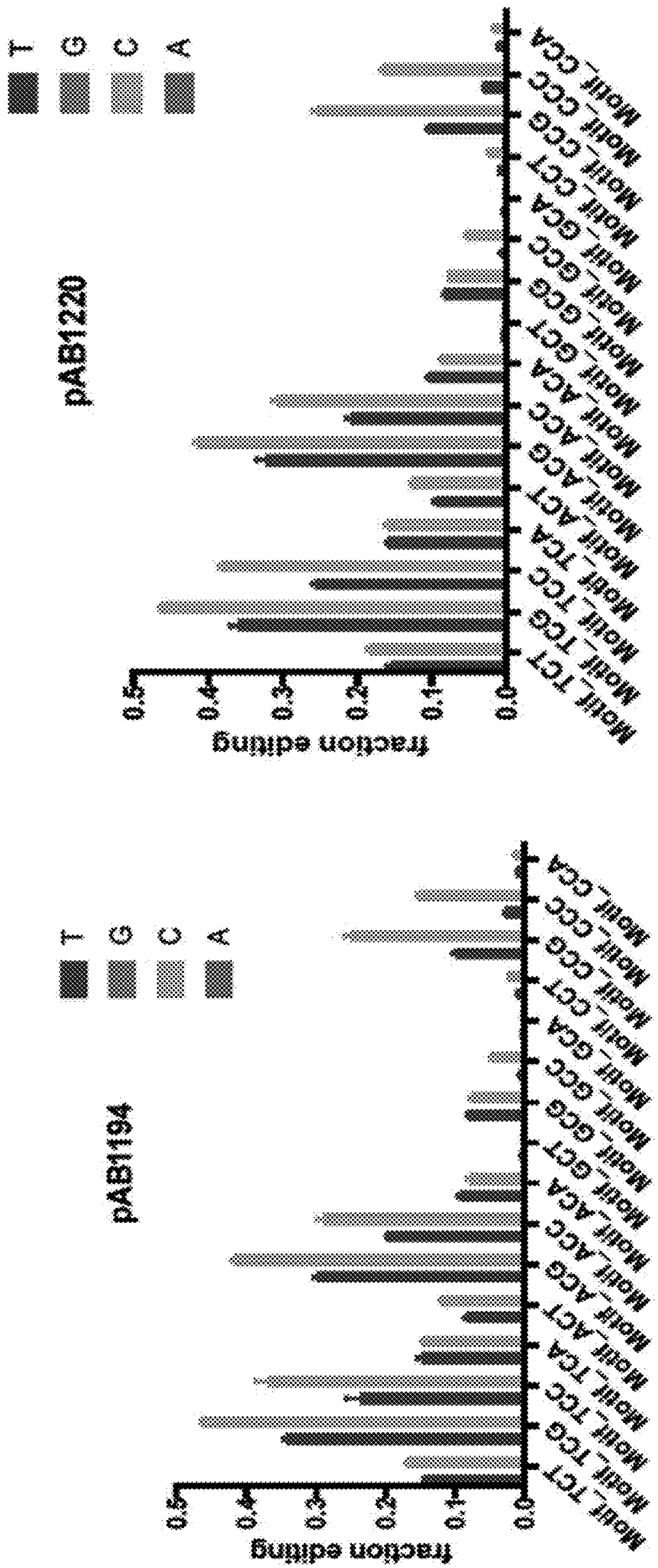
FIG. 65 shows Base flip and motif testing.
Figure 66:
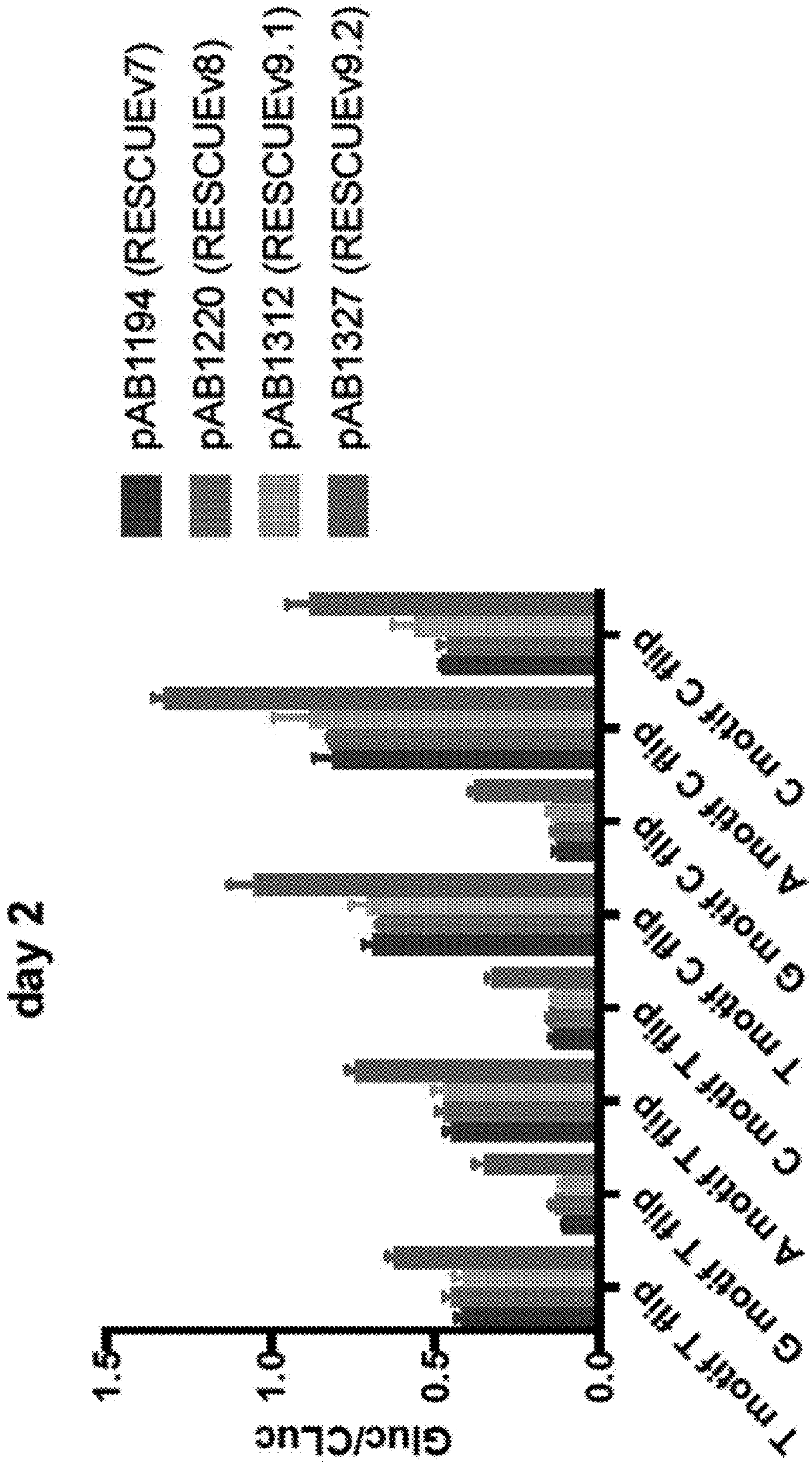
FIG. 66 shows effects of RESCUE v9 as tested on different motif flip.
Figure 67:
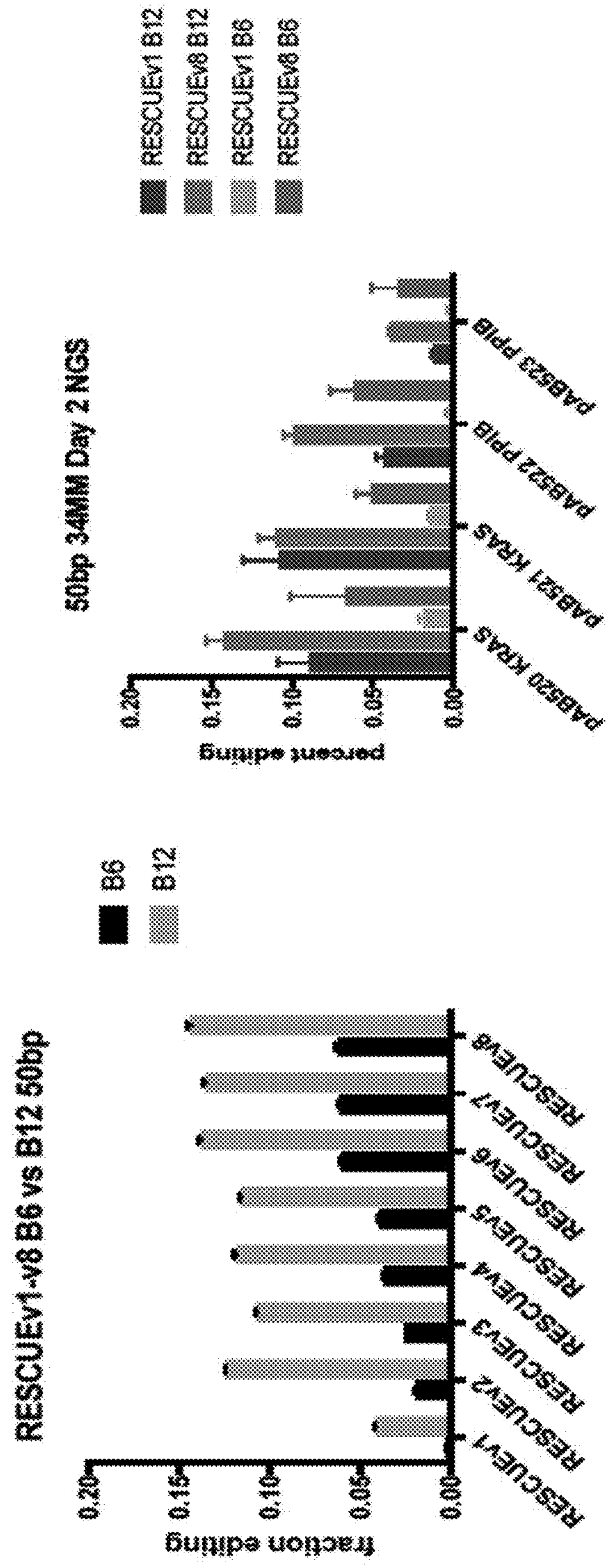
FIG. 67 shows comparison between B6 and B12 with RESCUE v1 and v8 with 50 bp guides.
Figure 68:
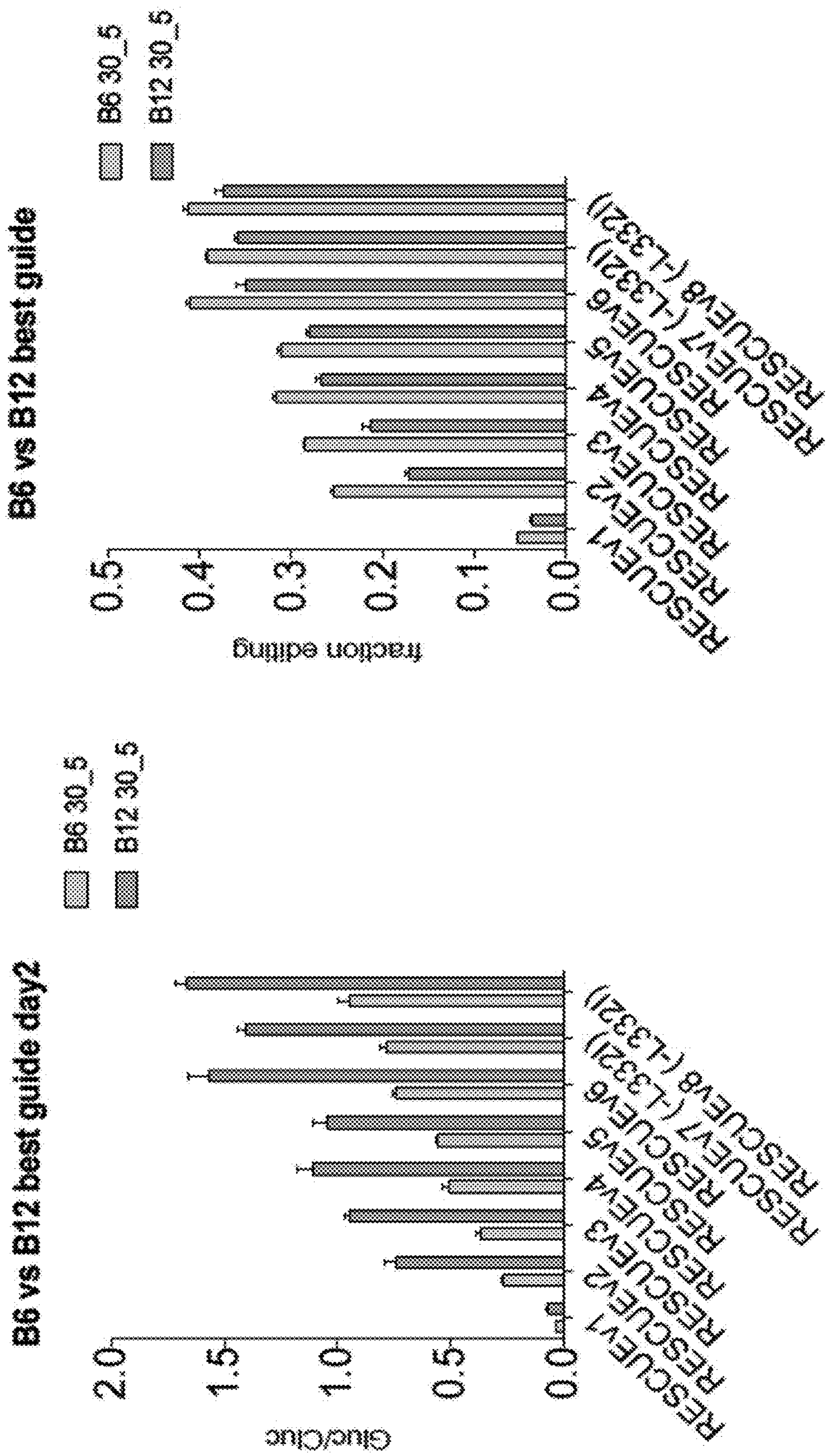
FIG. 68 shows comparison between B6 and B12 with RESCUE v1 and v8 with 30 bp guides.
Figure 70:
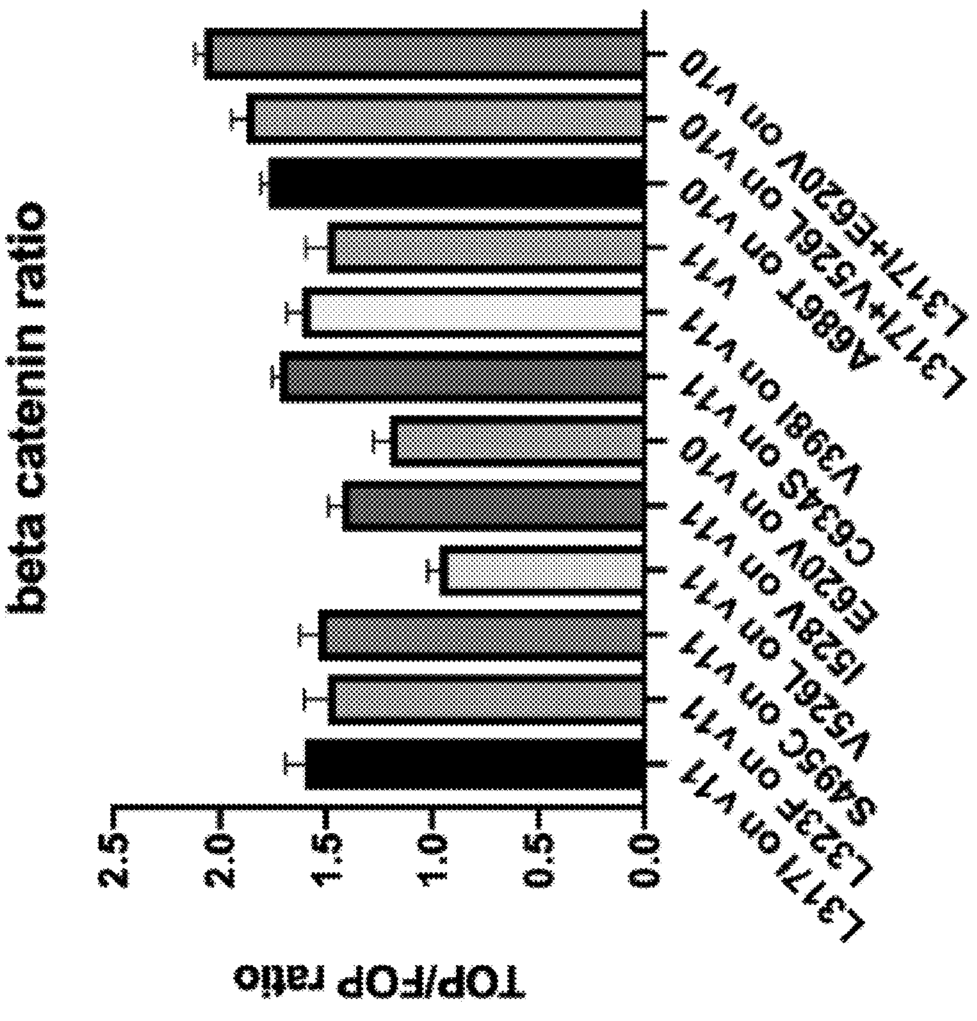
FIG. 70 is a graph illustrating results of an experiment in which better beta catenin mutants were selected.
Figure 71:
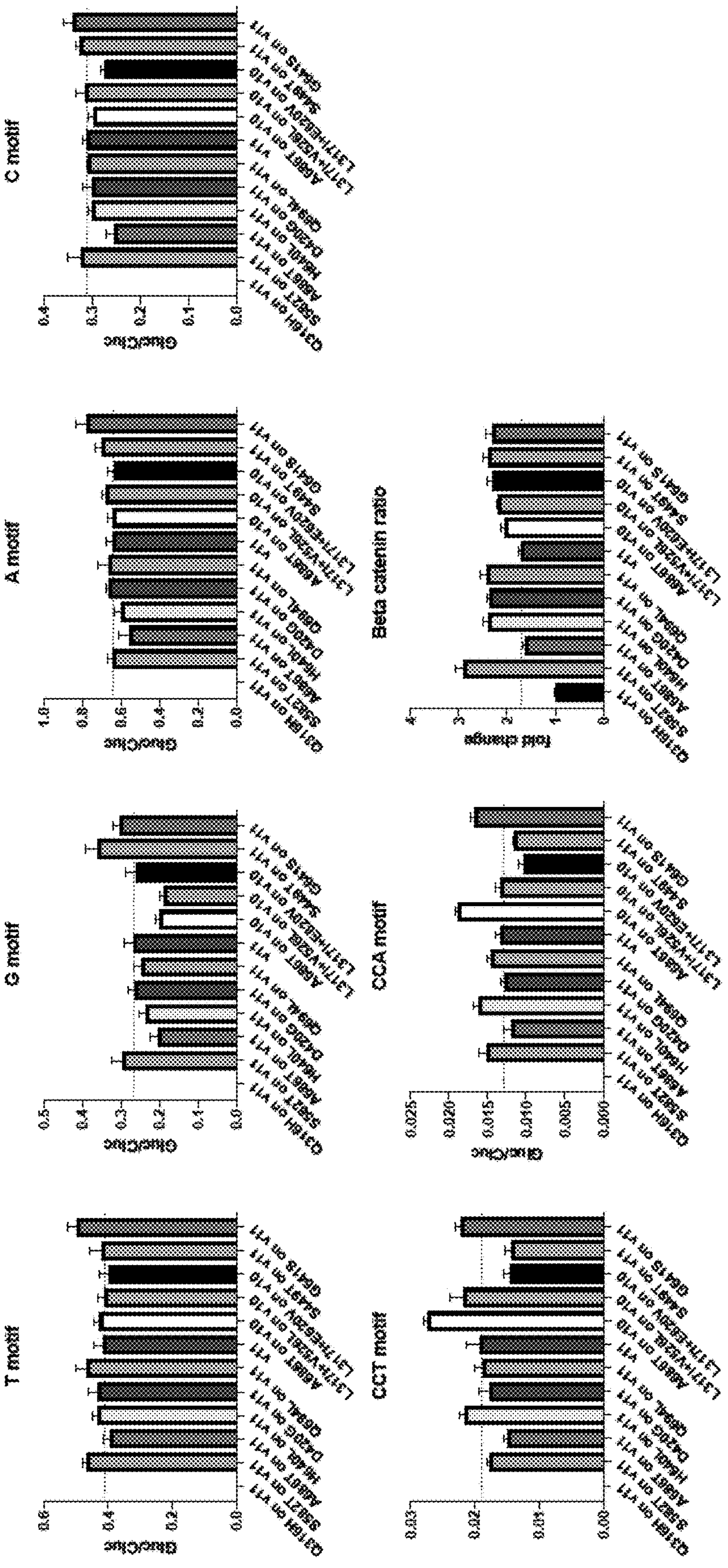
FIG. 71 shows graphs illustrating results of RESCUE round 12.
Figure 72:
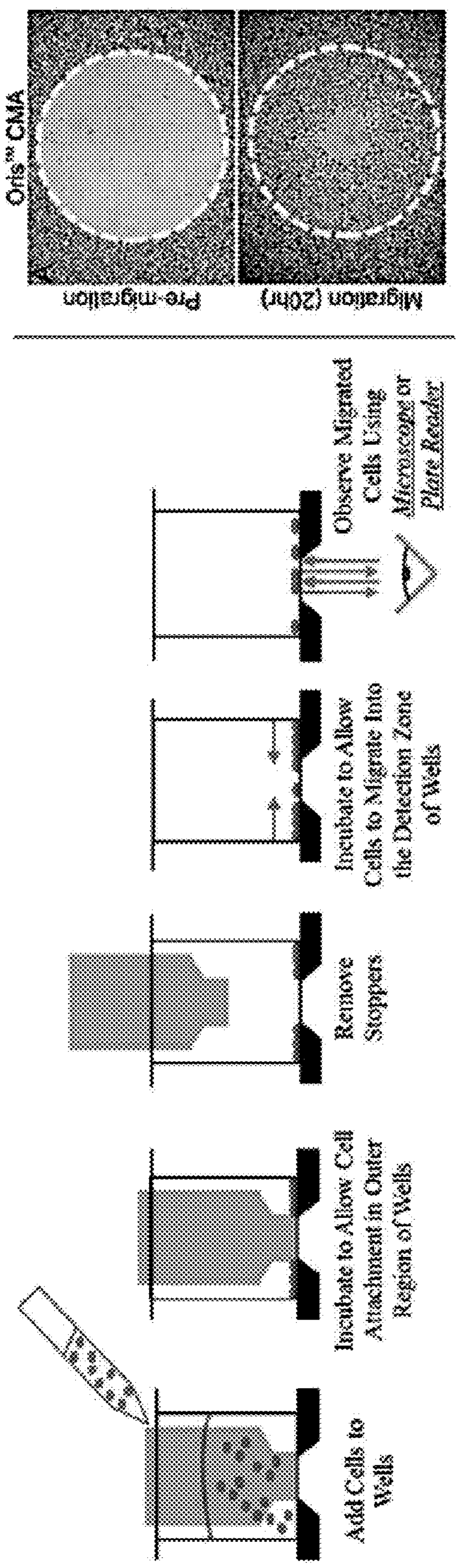
FIG. 72 is a schematic illustrating the beta catenin migration assay.
Figure 73:
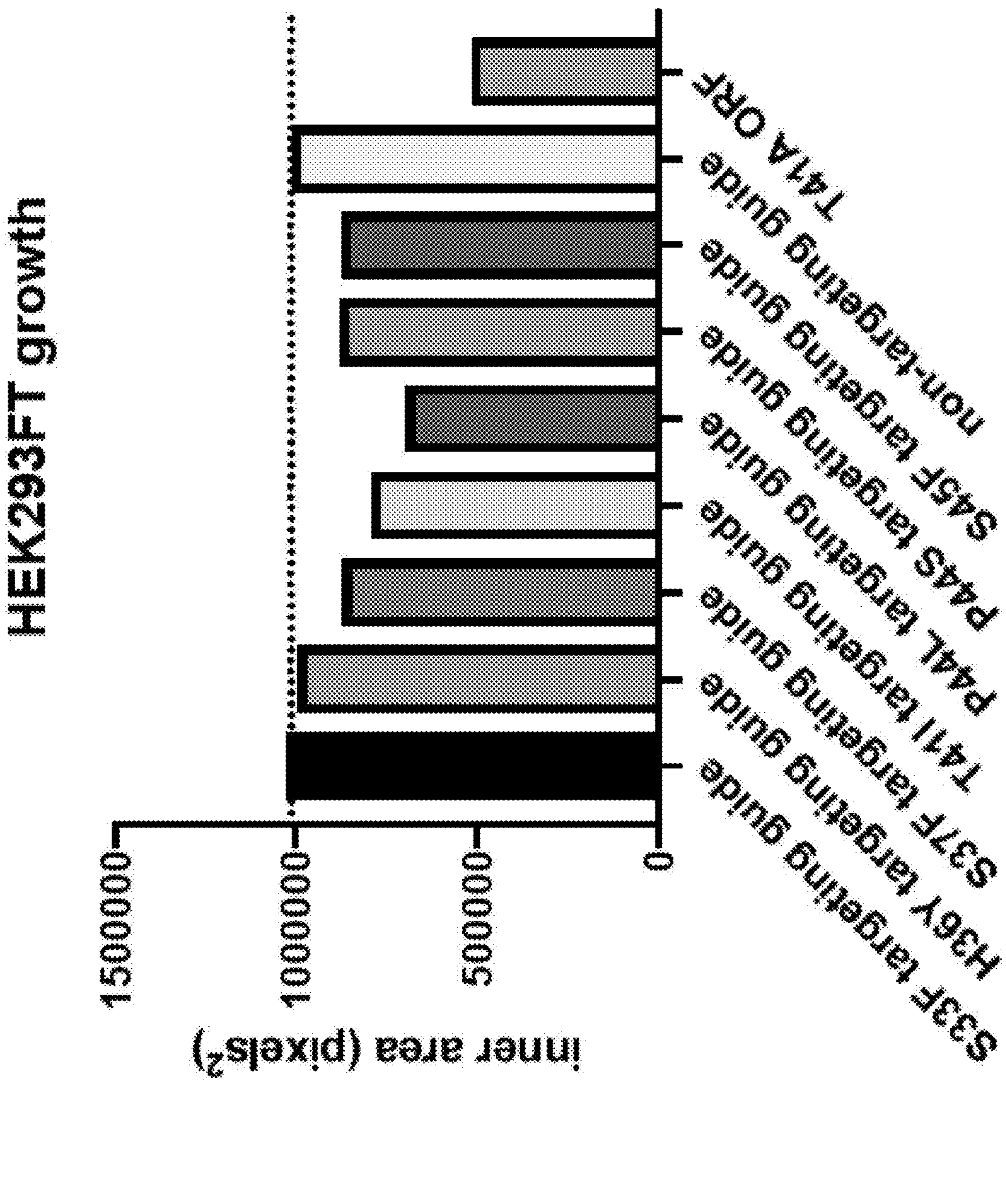
FIG. 73 is a graph showing results of a cell migration assay induced by beta catenin.
Figure 74:
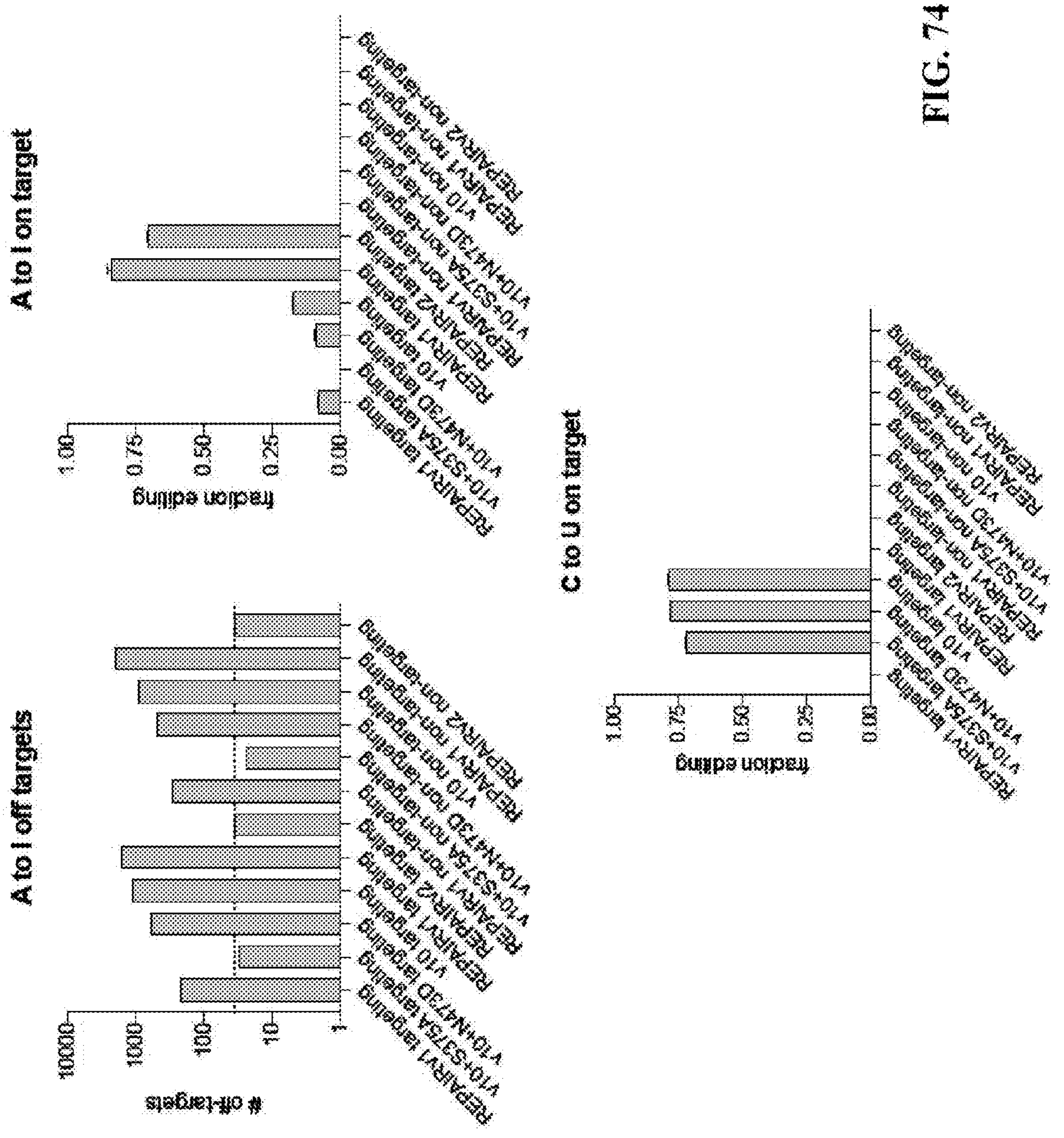
FIG. 74 shows graphs illustrating that specificity mutations eliminate A-I off-targets.
Figure 75A:
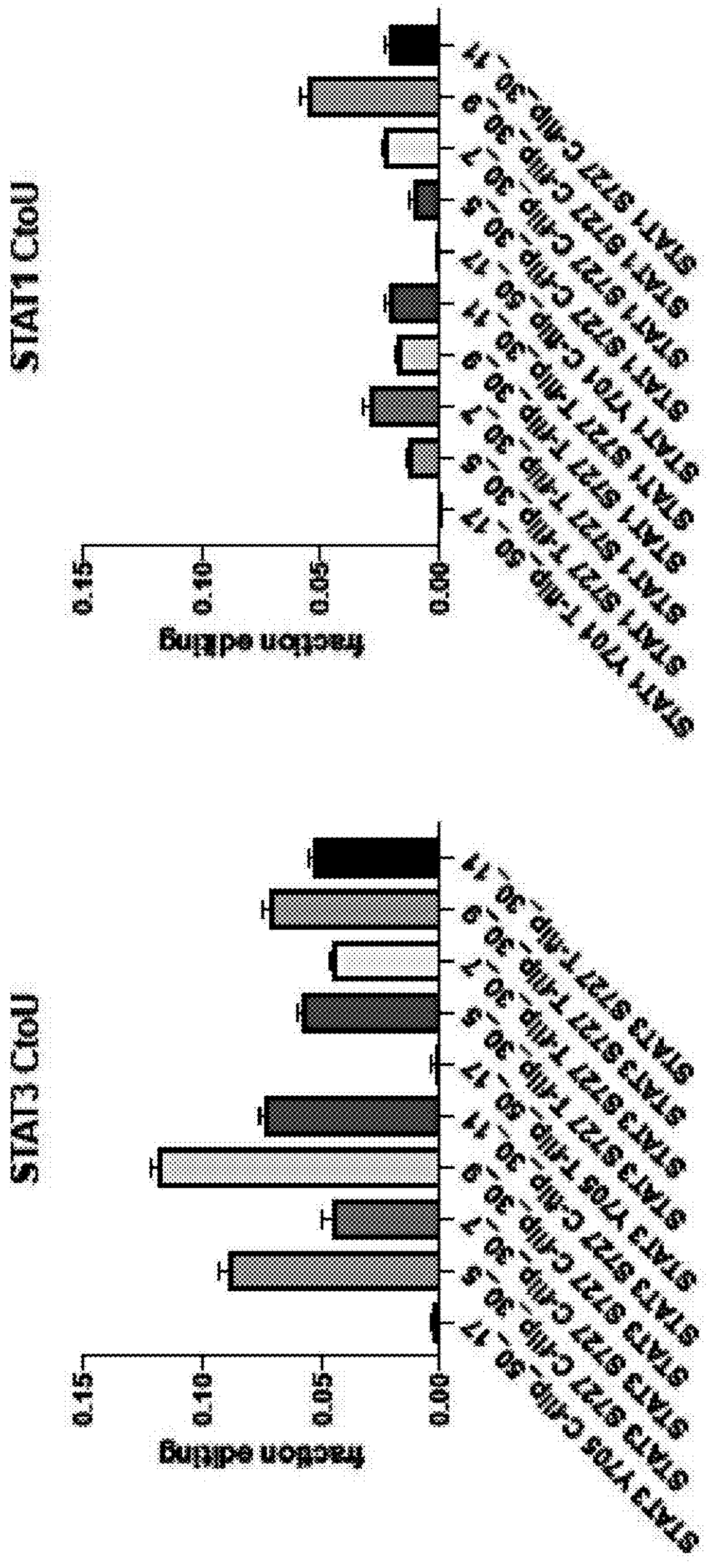
FIGS. 75A-75B shows graphs illustrating that targeting Stat1/3 phosphorylation sites reduces signaling.
Figure 75B:
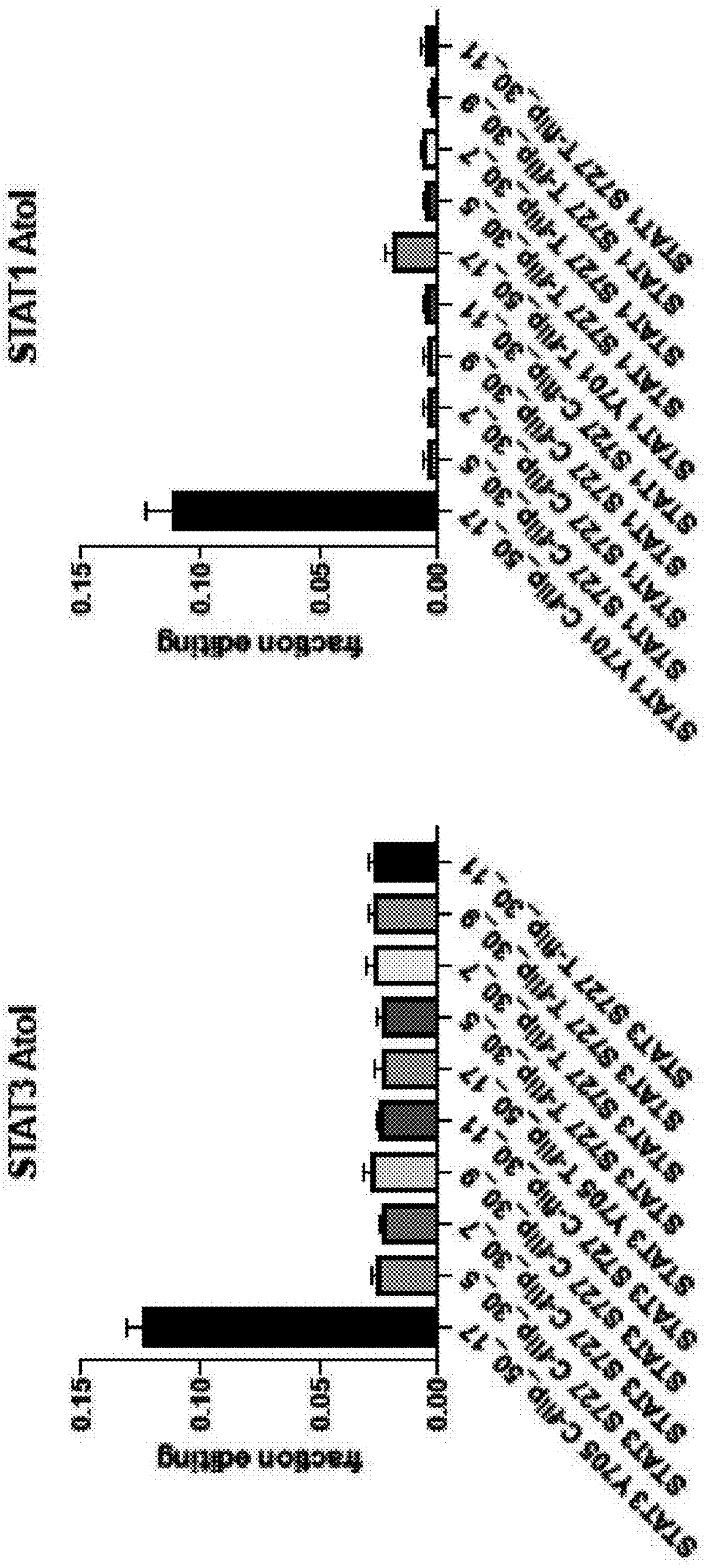
Figure 76:
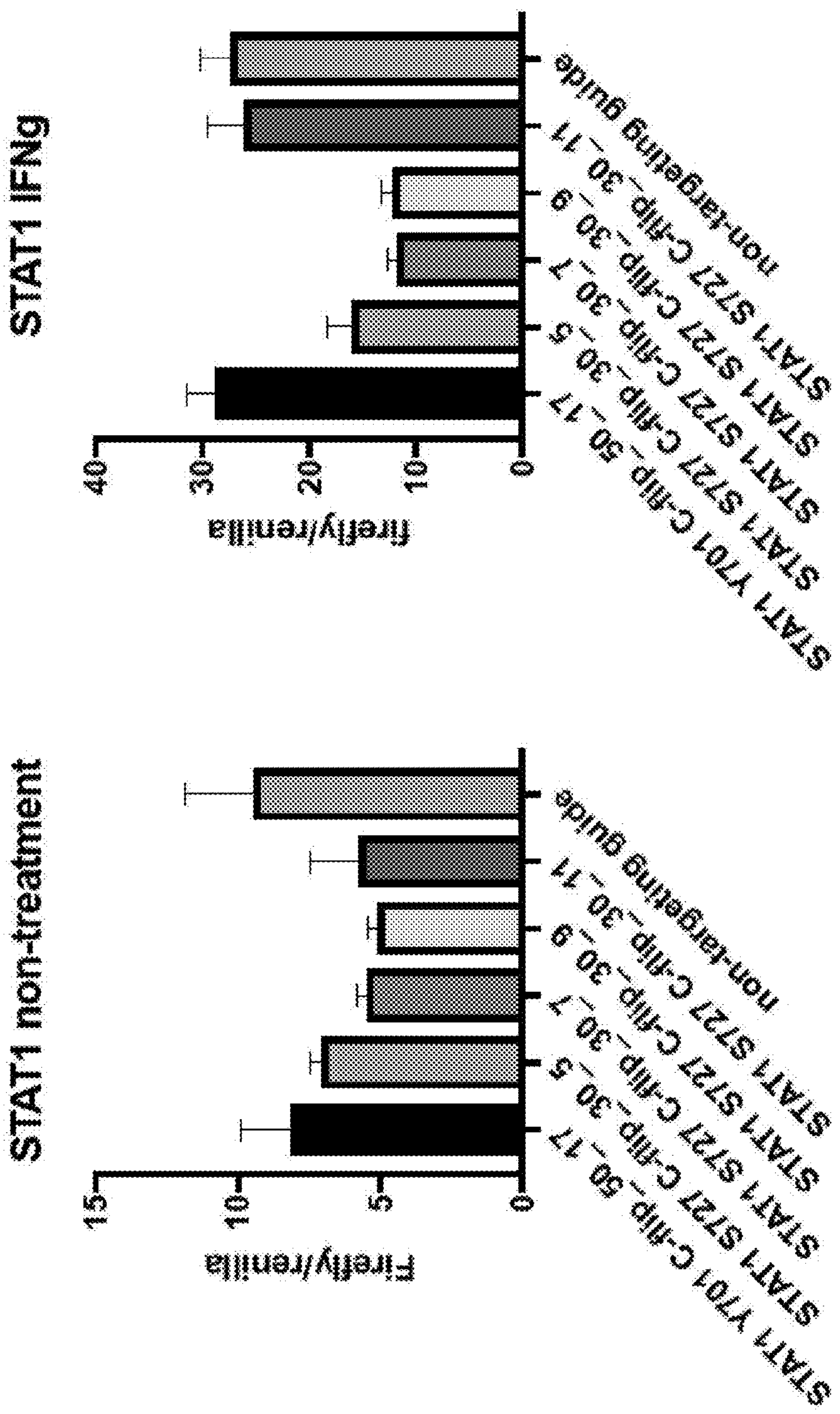
FIG. 76 shows graphs illustrating that targeting Stat1/3 phosphorylation sites reduces signaling, with FIG. 64A showing results for STAT1 non-treatment and FIG. 64B showing results for STAT1 IFNγ treatment.
Figure 77:
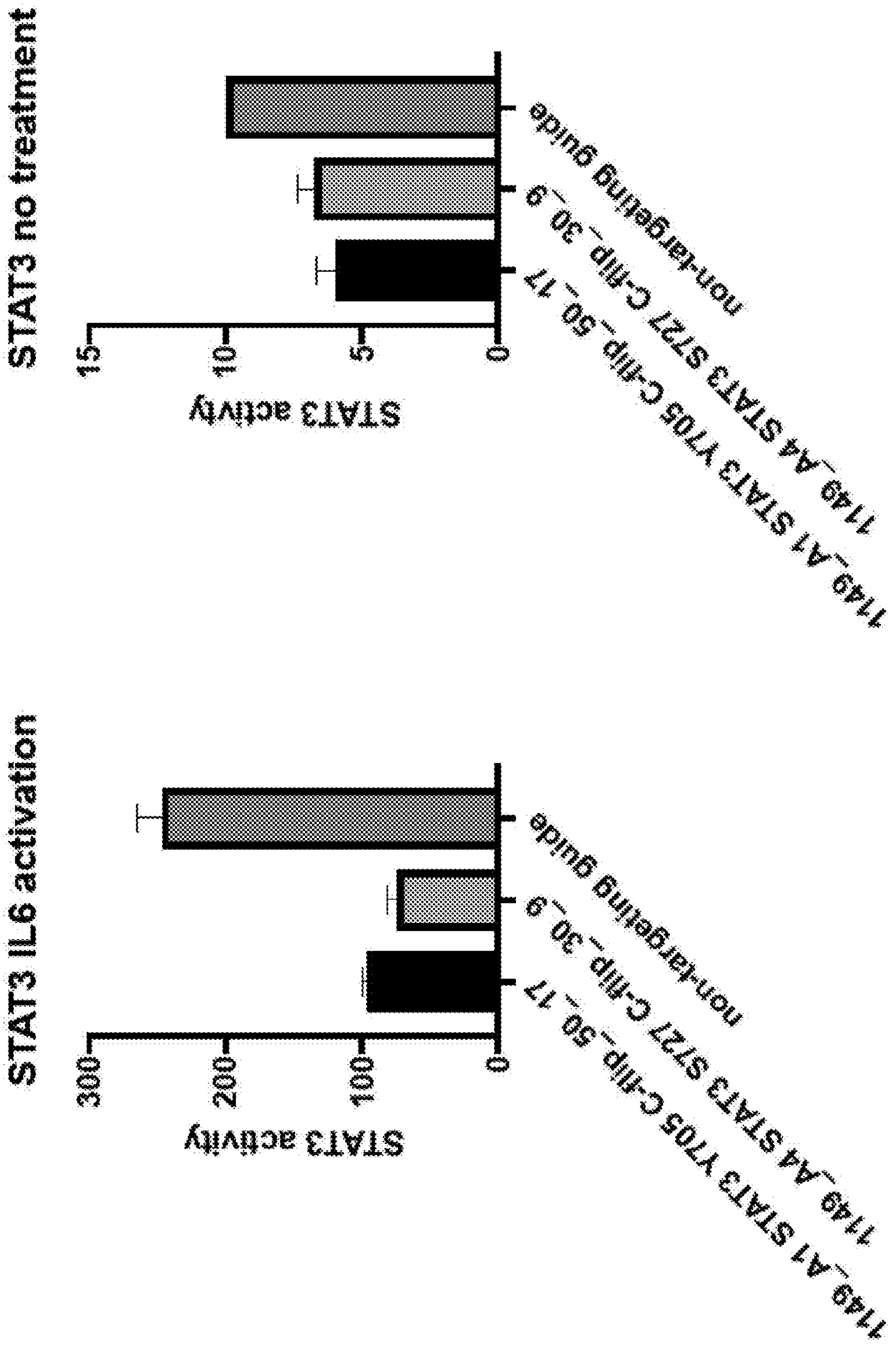
FIG. 77 shows graphs illustrating that targeting Stat1/3 phosphorylation sites reduces signaling, with FIG. 65A showing results for STAT3 IL6 activation and FIG. 65B showing results for STAT3 no treatment.
Figure 78:
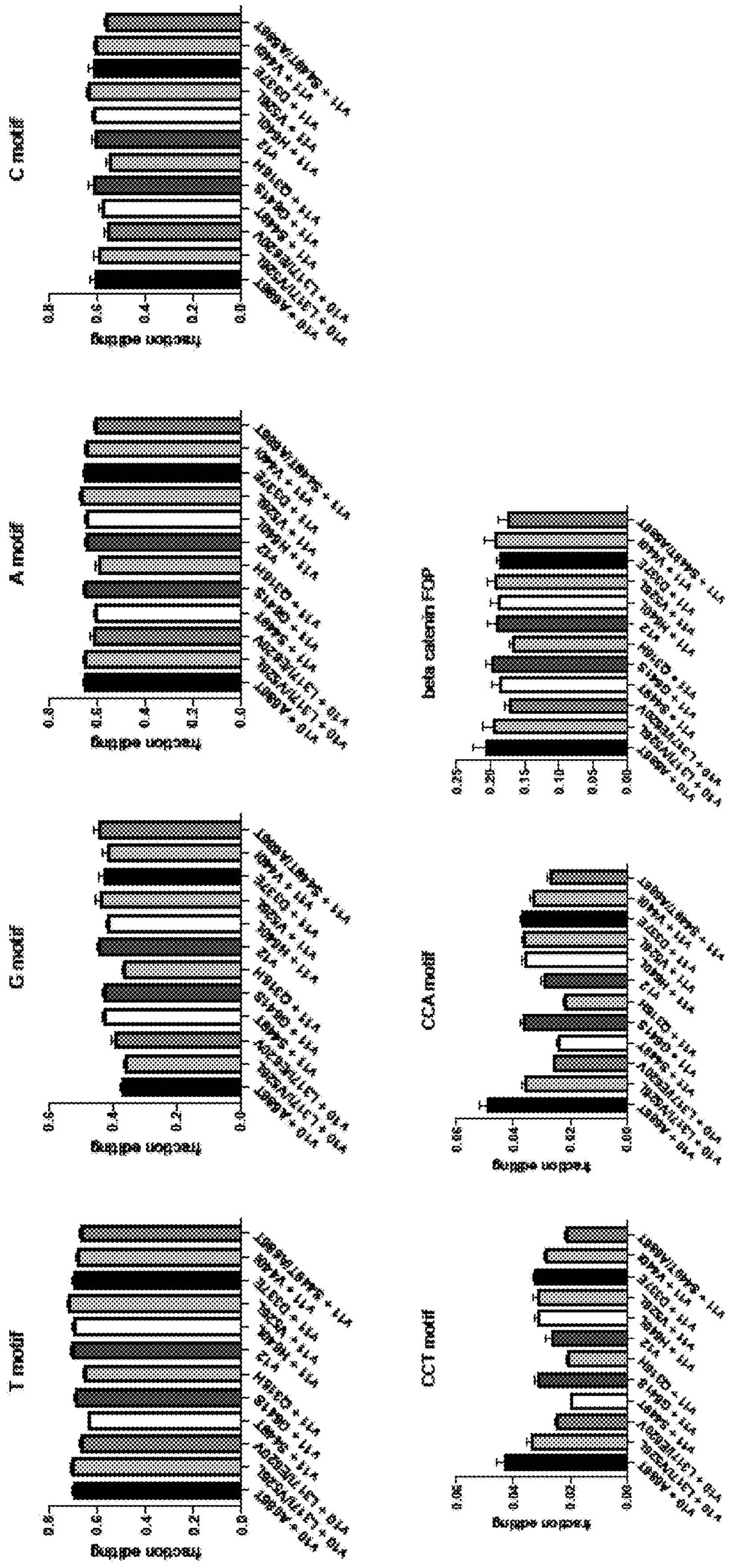
FIG. 78 shows graphs illustrating results of RESCUE round 12.
Figure 79:
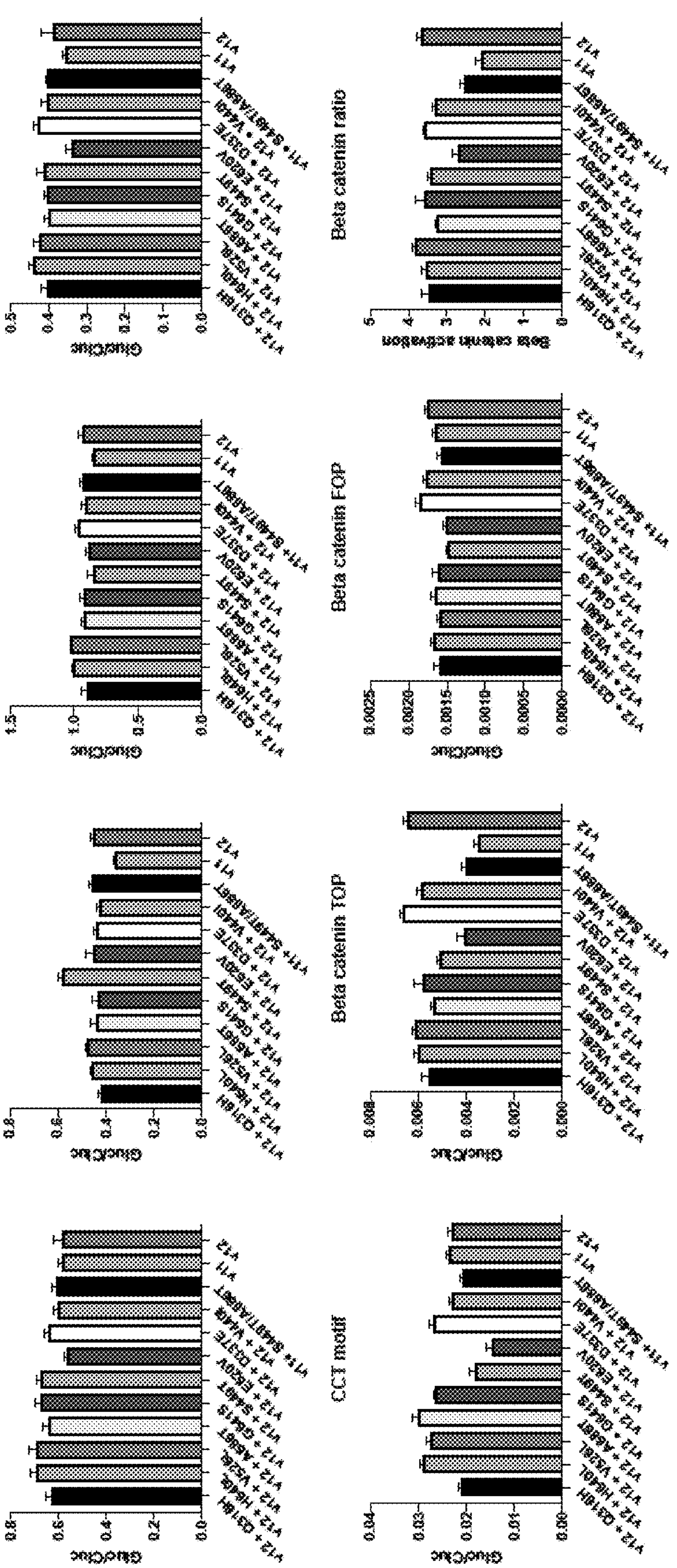
FIG. 79 shows graphs illustrating results from a RESCUE round 13.
Figure 80:
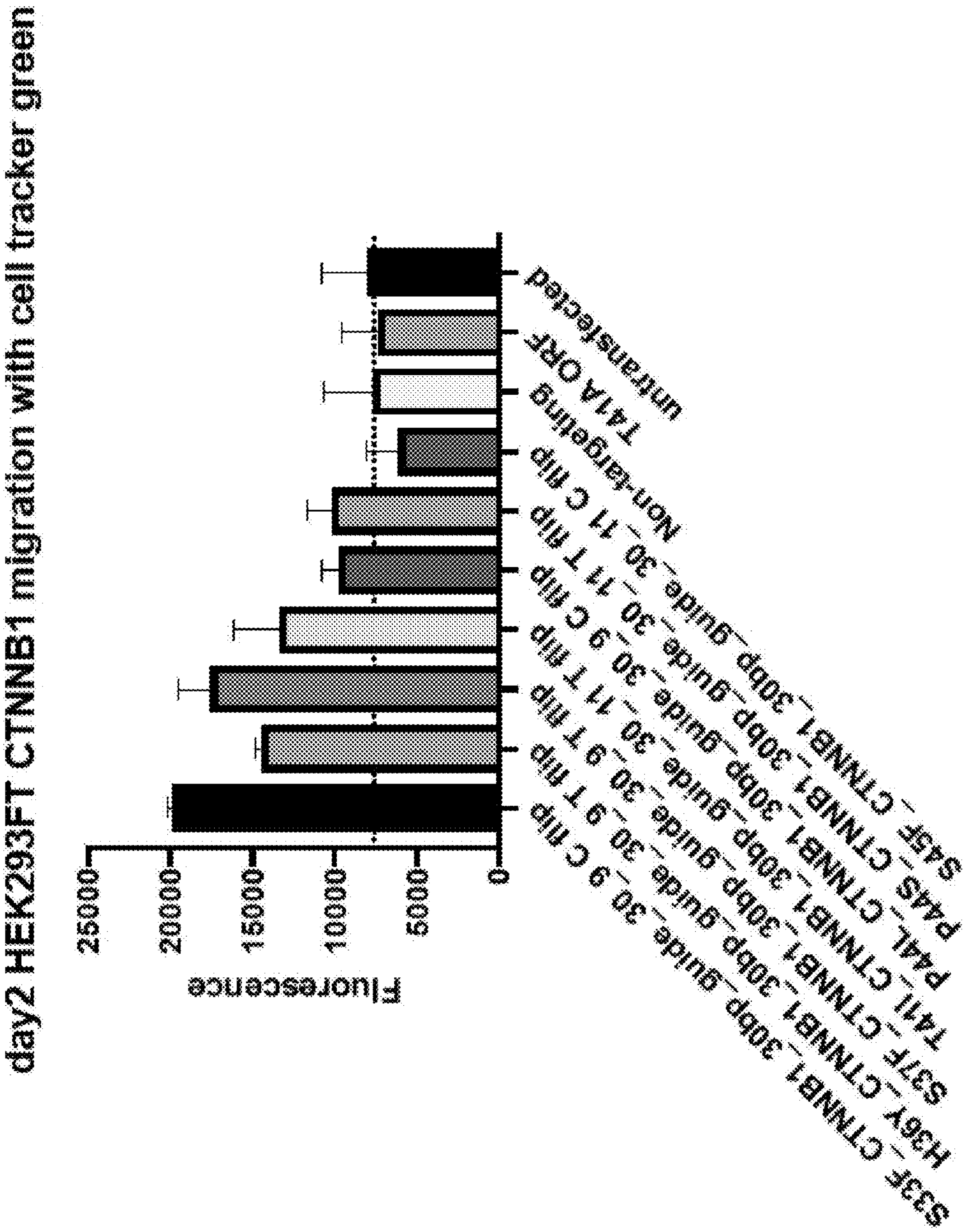
FIG. 80 is a graph showing results of a cell migration assay induced by beta catenin.
Figure 81:
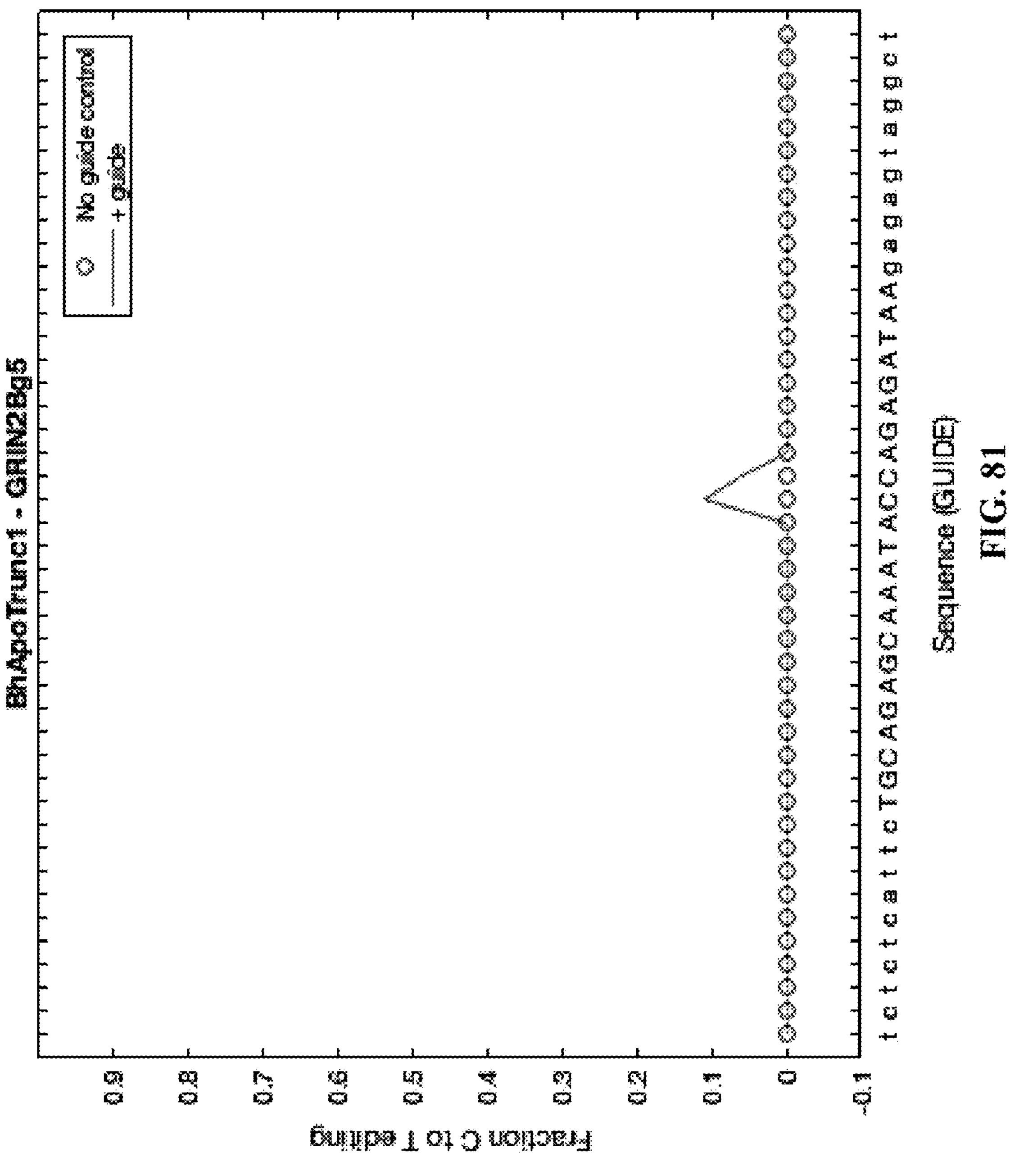
FIG. 81—Bhv4 truncations with C to T base editing capabilities. After removing the C-terminal 142 amino acids of catalytically inactive Bhv4 (dBhv4Δ143—inactivating mutation D574A, new size 966 amino acids) and fusing a linker and rat Apobec domain to the C-terminal end, C to T base editing is observed with frequencies up to 10.95% at guide base pair position 14 on the non-target strand. A 6.97% editing efficiency is detected at guide position 15. This activity is guide dependent. The addition of the uracil-DNA glycosylase inhibitor (UGI) domain, either through fusion to the existing construct or free expression, is expected to increase this C to T conversion. The listed guide sequence (capitalized letters) targets a region inside GRIN2B in HEK 293T cells (SEQ ID NO: 368).
Figures 82A, 82B:
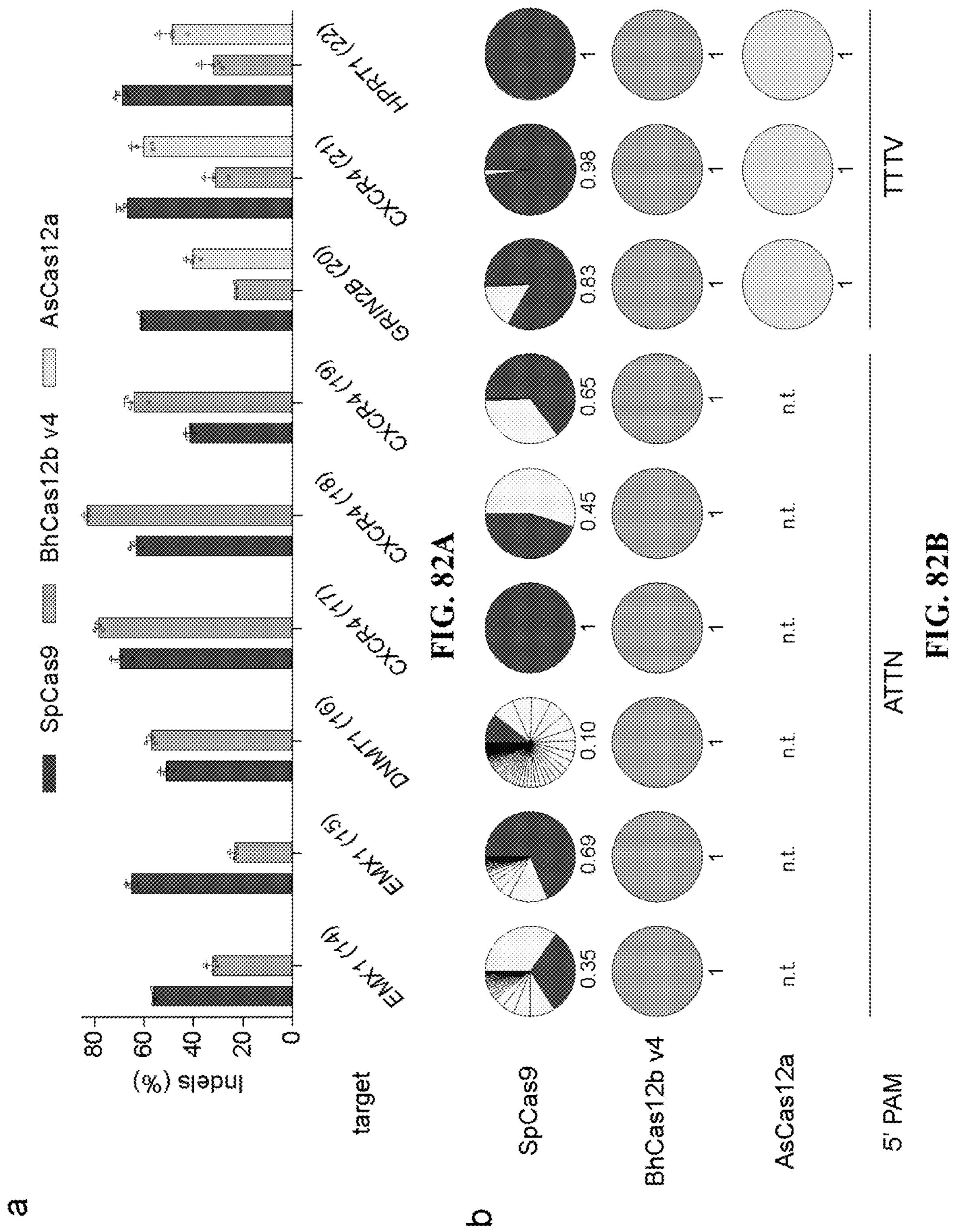
FIGS. 82A-82C-FIG. 82A) Comparison of Cas9, Cas12b, and Cas12a indel activity in 293T cells at 9 target sites (except for Cas12a, which was only tested at the three TTTV PAM sites) selected for Guide-Seq analysis. Error bars represent s.d. from n=4 replicates.
Figure 82C:
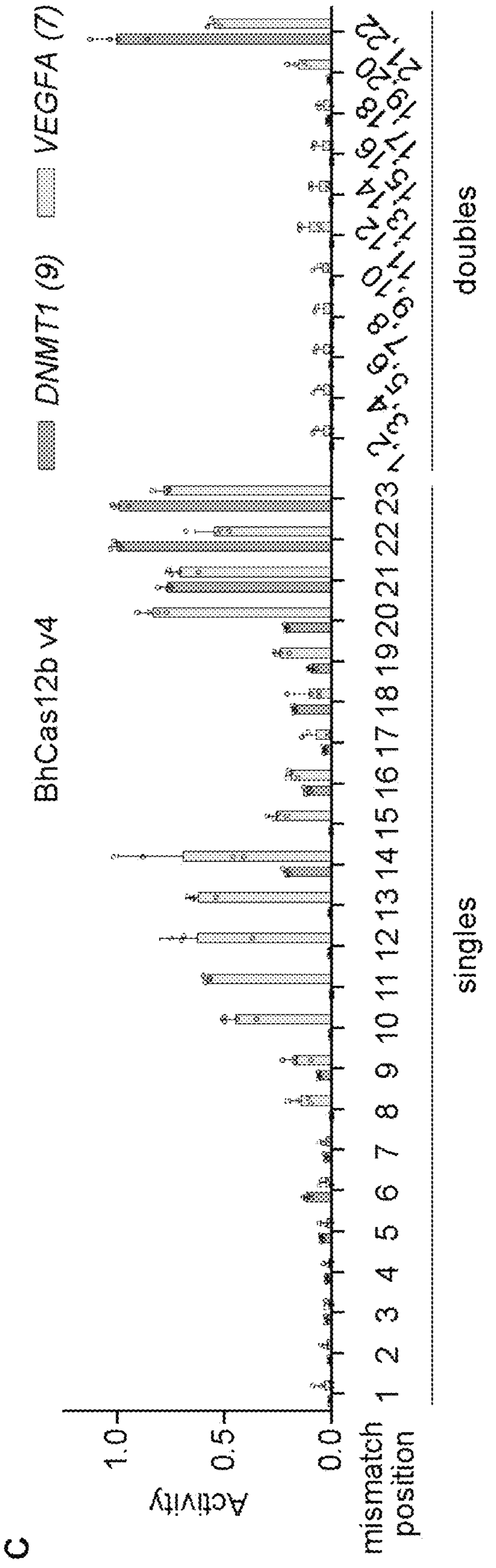
Figure 83:
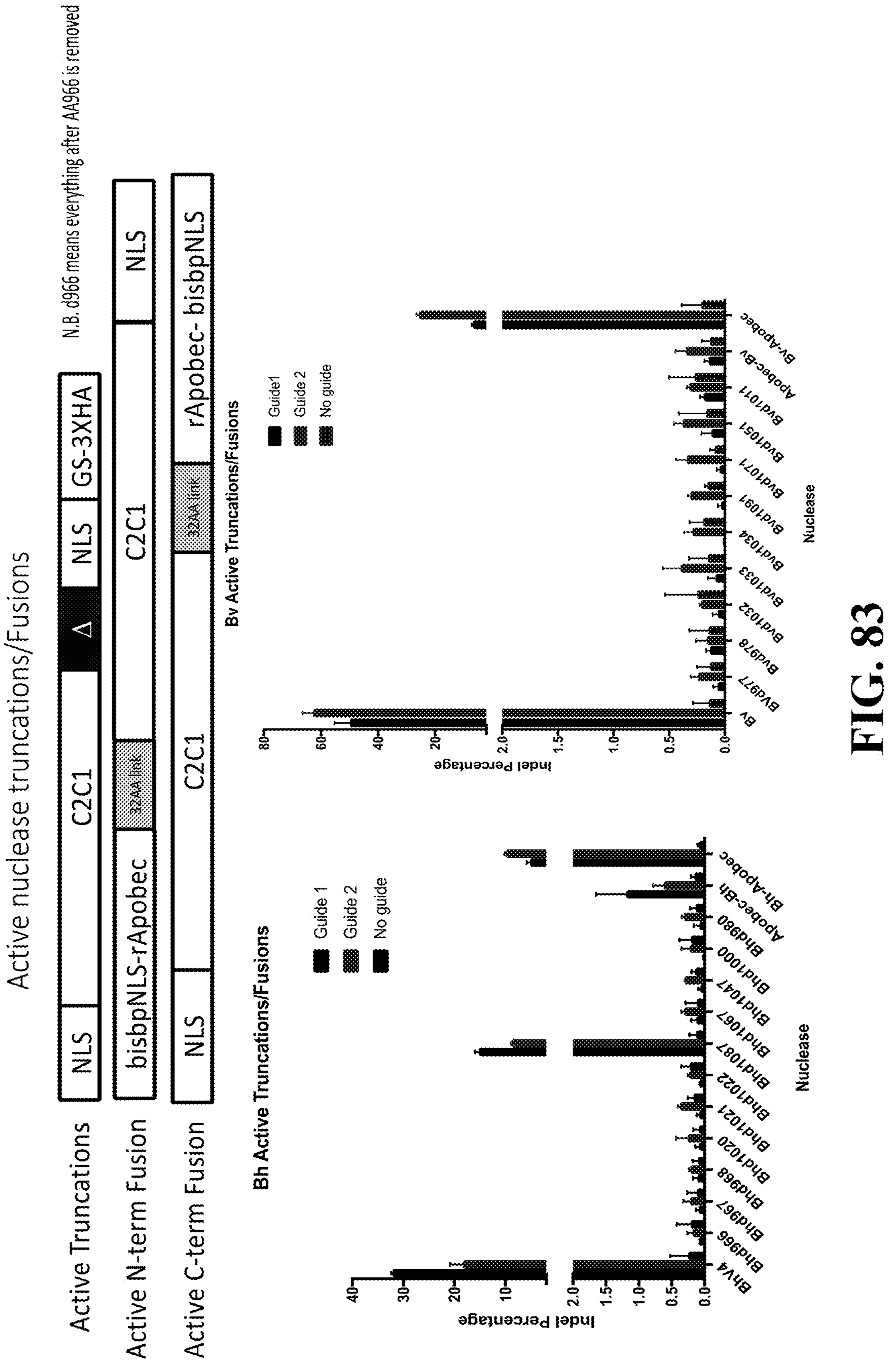
FIG. 83—provides schematics of Cas12 truncations and N- and C-terminal fusions with APOBEC and base editing activity of same.
Figure 84:
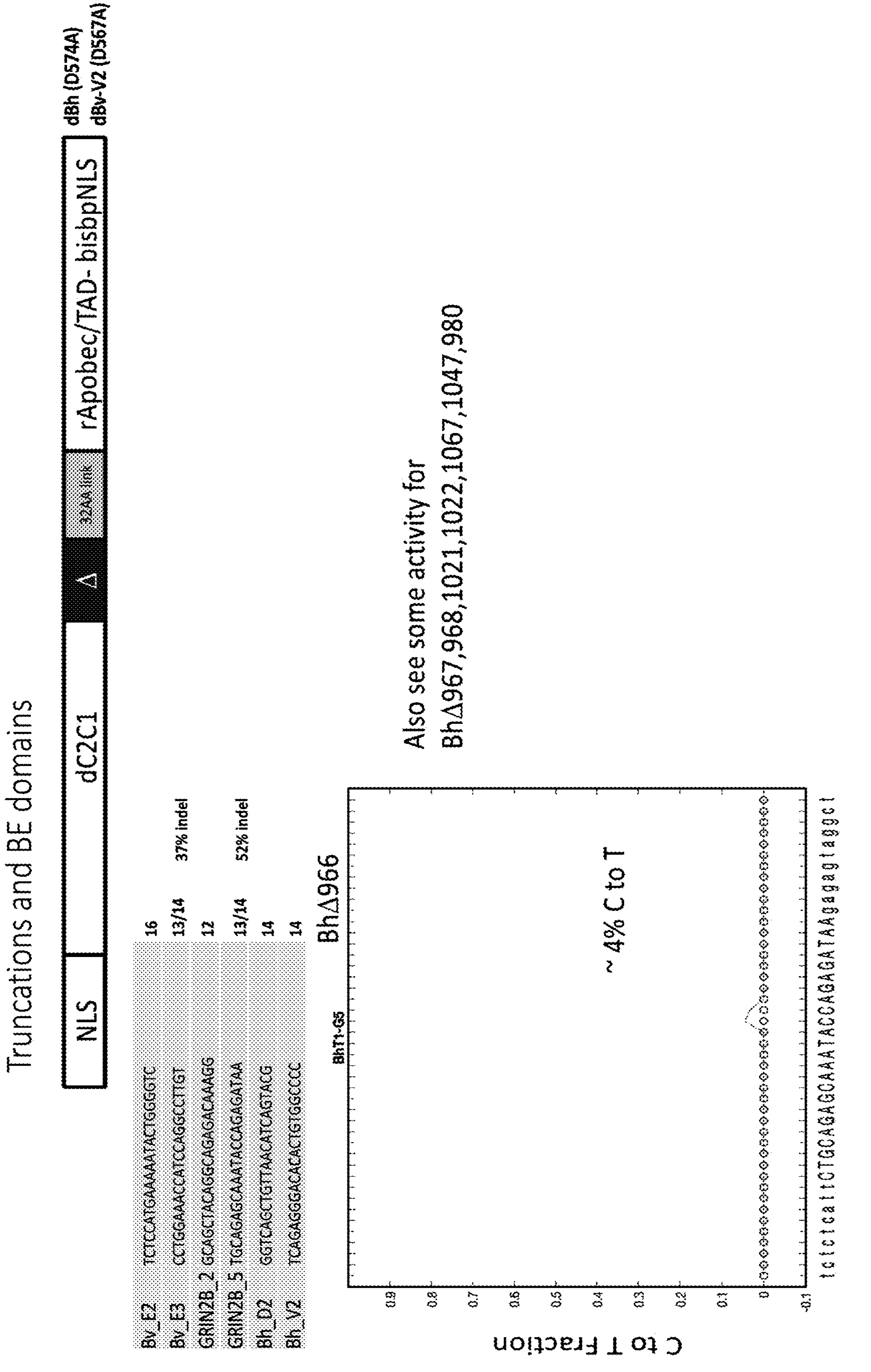
FIG. 84—provides Cas12 base editing data in accordance with certain example embodiments (SEQ ID NO: 369-375).
Figure 86:
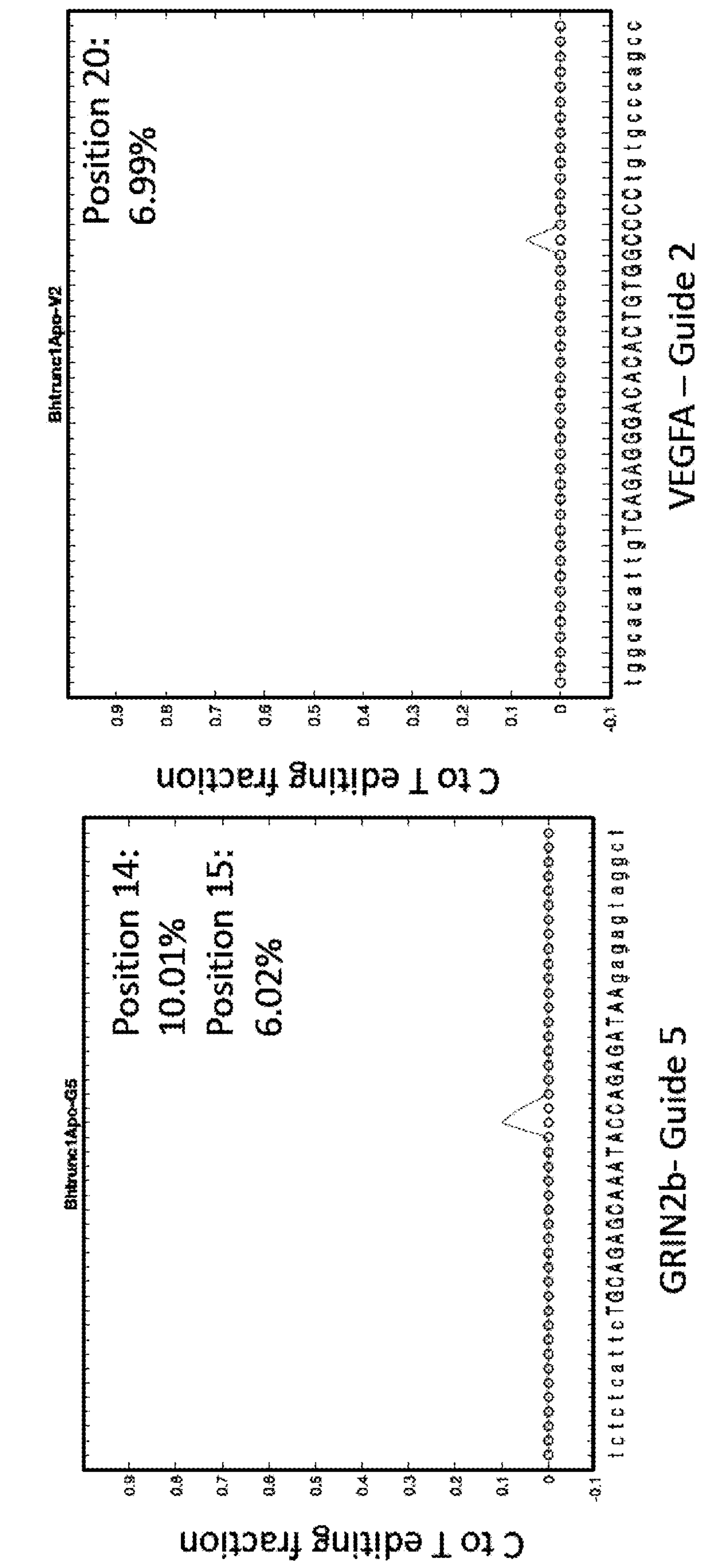
FIG. 86—provides Cas12 base editing on guides in accordance with certain example embodiments (SEQ ID NO: 376-377).

Screening for mutations for RESCUE v9 was performed (FIG. 63). Potential mutations for RESCUEv9 were identified (FIG. 64). Base flip and motif testing were performed (FIG. 65). Effects of RESCUEv9 was tested on different motif flip (FIG. 66). The data suggests v9 worked better with C-flip guides. Comparison between B6 and B12 with RESCUE v1 and v8 were performed with 50 bp guides (FIG. 67 and 30 bp guides (FIG. 68).

Example 28

This example summarizes the results of RESCUE rounds 1-12 (see FIGS. 69-80). Additional phenotypes tested included PCSK9, Stat3, IRS1, and TFEB. PCSK9 showed cloning improved the promoter. Stat3 showed ~10% editing on sites. Inhibition of signaling will be tested with a luciferase reporter. For IRS1, targeting of synthetic site will be tested before moving to pre-adipocyte cells. For TFEB, targeting may be designed to cause translocation of transcription factor→autophagy. In addition, a panel of 12 endogenous phosphosite targets and 48 synthetic targets will be tested. Screening in yeast will continue on V11 background with S22P. Top hits were screened on V12 for V13 and new rounds of yeast hits will be evaluated. A few hundred additional screen hits on luciferase will be evaluated and Ade2 editing will be validated for specificity screening. Gene shuffling will also be tested for library complexity and different yeast reporters.

Example 29

This example demonstrates an exemplary approach for base editing using Cas12b and variants thereof and a deaminase.

FIGS. 81, 83-86 show Cas12b Bhv4 truncations with C to T base editing capabilities. After removing the C-terminal 142 amino acids of catalytically inactive Bhv4 (dBhv4A142-inactivating mutation D574A, new total size 966 amino acids) and fusing a linker and rat Apobec domain to the C-terminal end, C to T base editing was observed with frequencies up to 10.95% at guide base pair position 14 on the nontarget strand. A 6.97% editing efficiency was detected at guide position 15. This activity was guide dependent. The addition of the uracil-DNA glycosylase inhibitor (UGI) domain, either through fusion to the existing construct or free expression, increases this C to T conversion. The listed guide sequence (capitalized letters) targets a region inside GRIN2B in HEK 293T cells.

Figure 87:
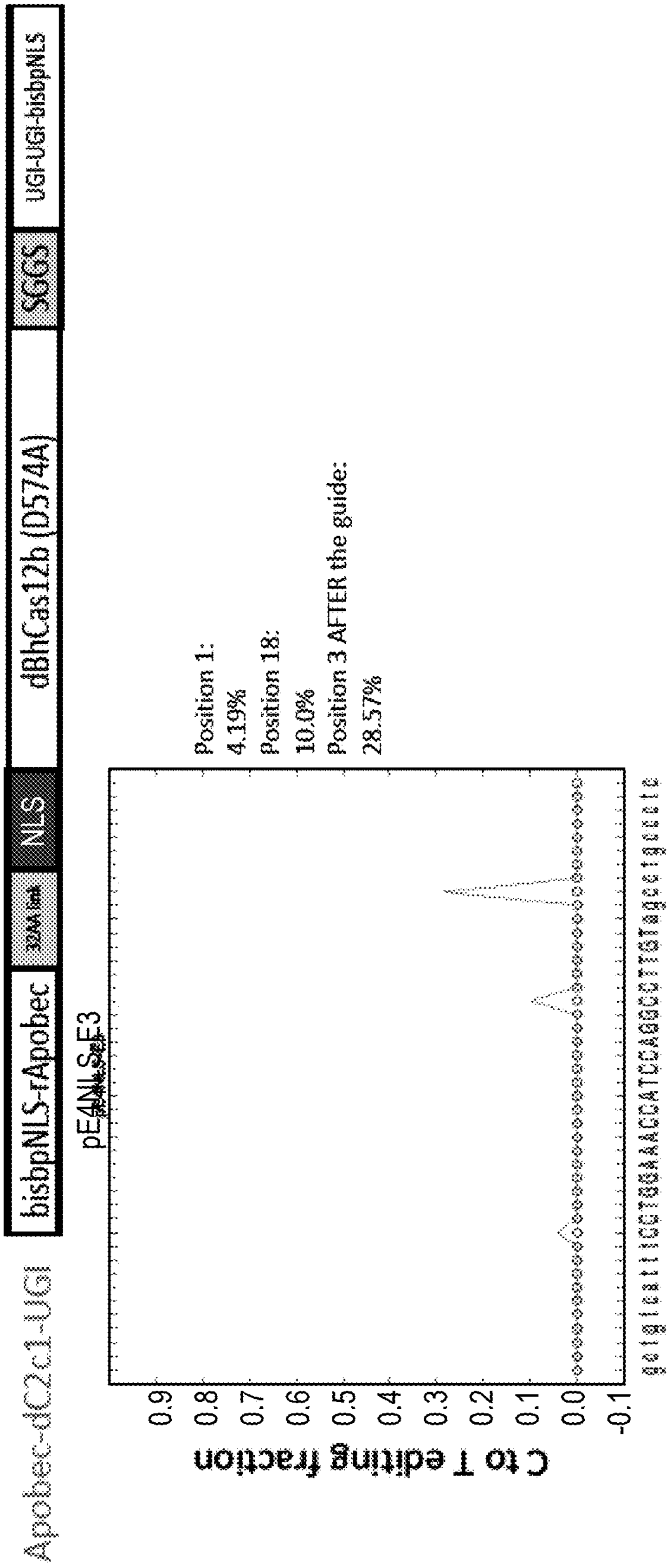
FIG. 87 shows an exemplary base editing approach using full-length BhCas12b (SEQ ID NO: 378).

FIG. 87 shows an exemplary base editing approach using full-length BhCas12b. A second NLS sequence was added to N-terminal rApobec to distance the domains from each other.

Example 30

Figure 88A:
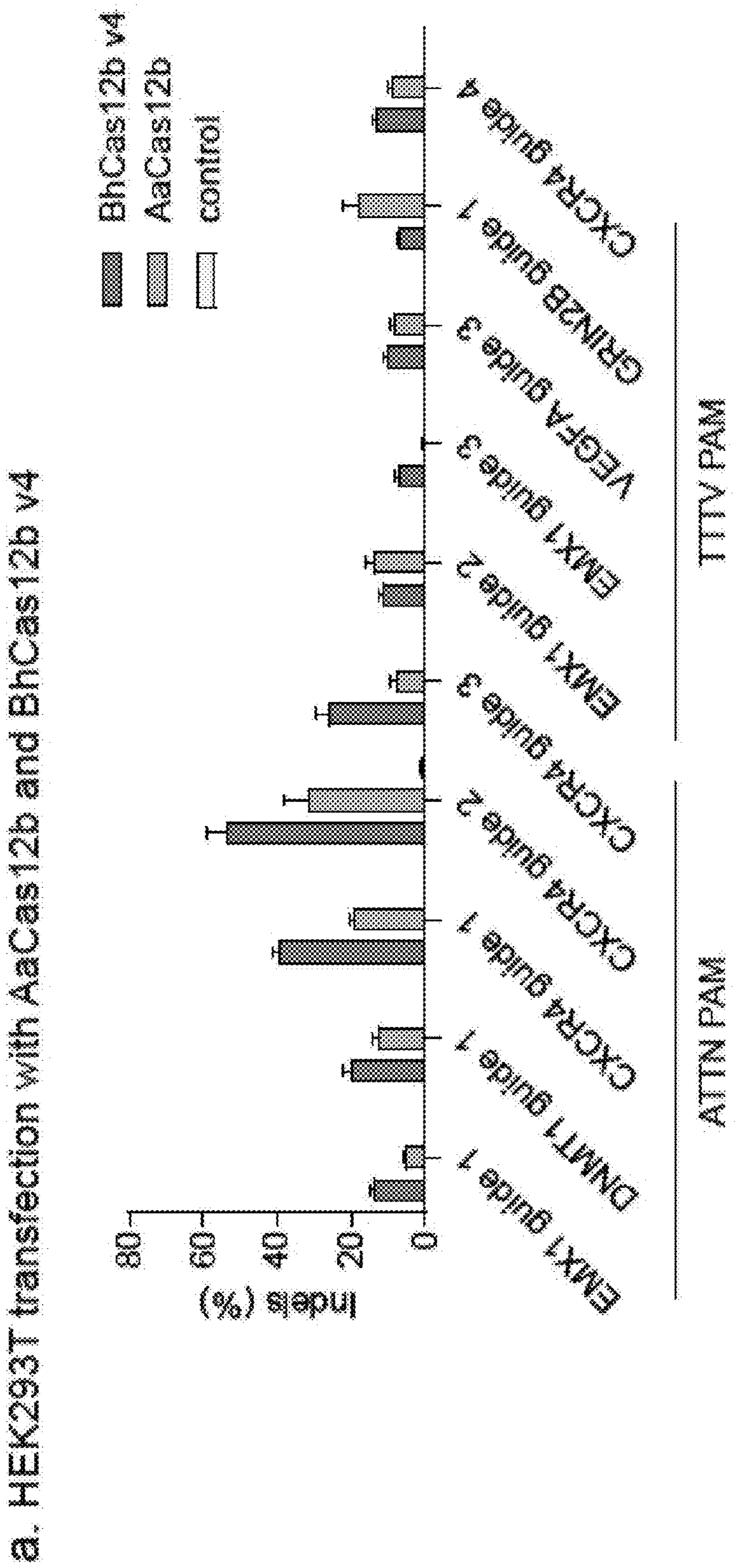
FIGS. 88A-88C—FIG. 88A show comparisons between indel activity of BhCas12b v4 and another ortholog AaCas12b.
Figure 88B:
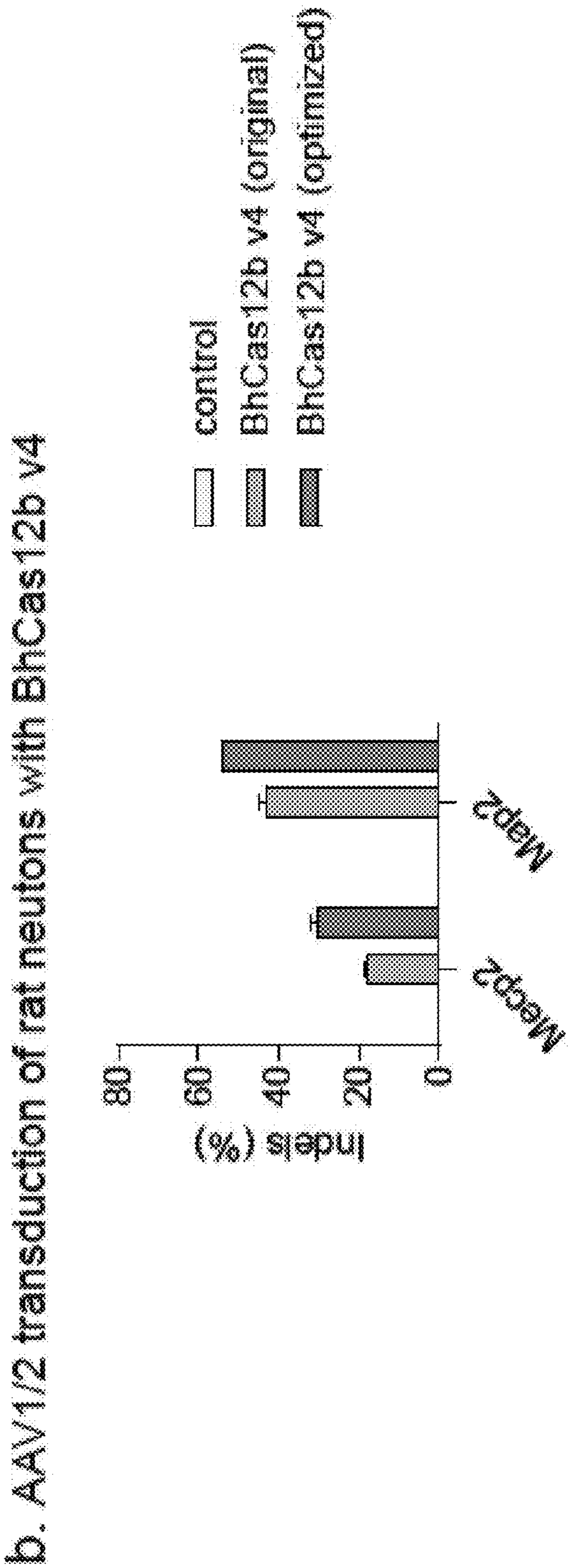
Figure 88C:
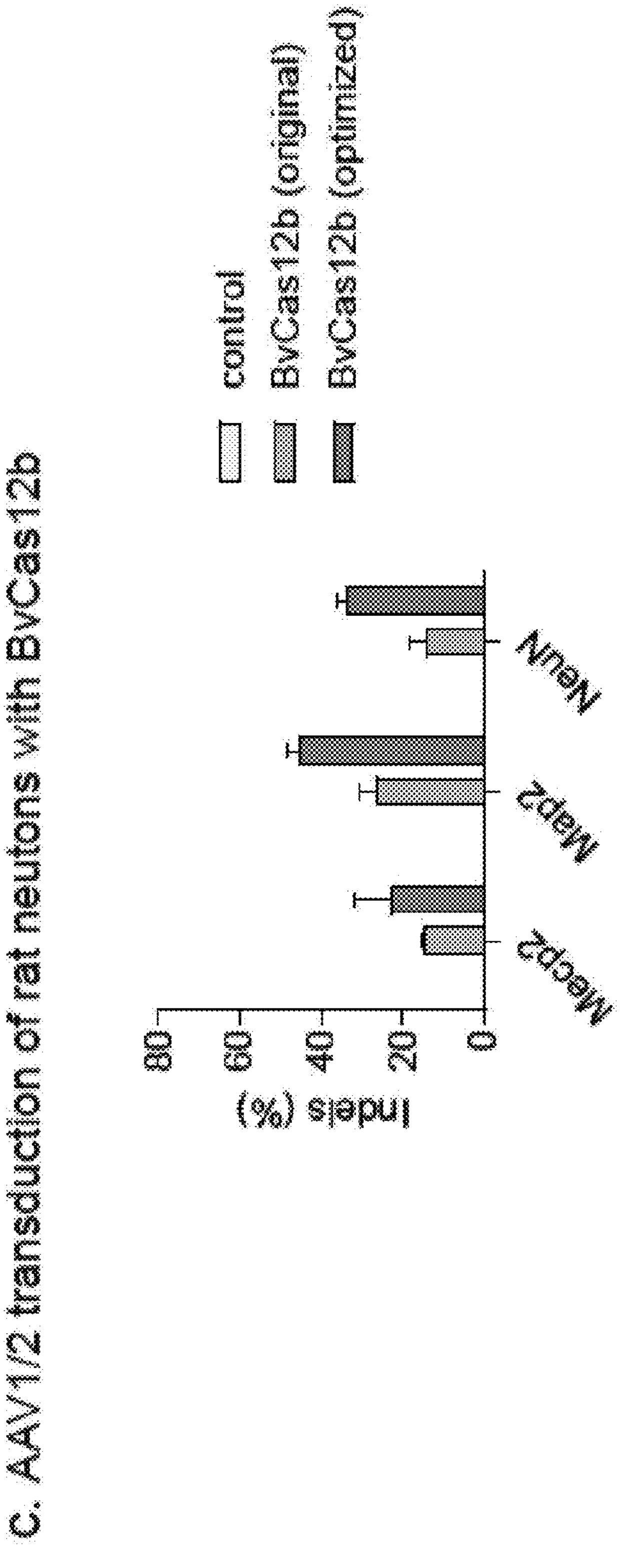

FIG. 88A shows comparison between indel activity of BhCas12b v4 and another ortholog AaCas12b (as described in Teng F. et al., Repurposing CRISPR-Cas12b for mammalian genome engineering in HEK293T cells. FIGS. 88B and 88C demonstrate the transduction of rat neurons with AAV1/2 expressing BhCas12b v4 or BhCas12b. This design exhibited higher activity as measured by indel activity. The polyA sequence was lengthened in the optimized vectors and the U6 promoter and sgRNA scaffold moved to the opposite strand.

Figure 89A:
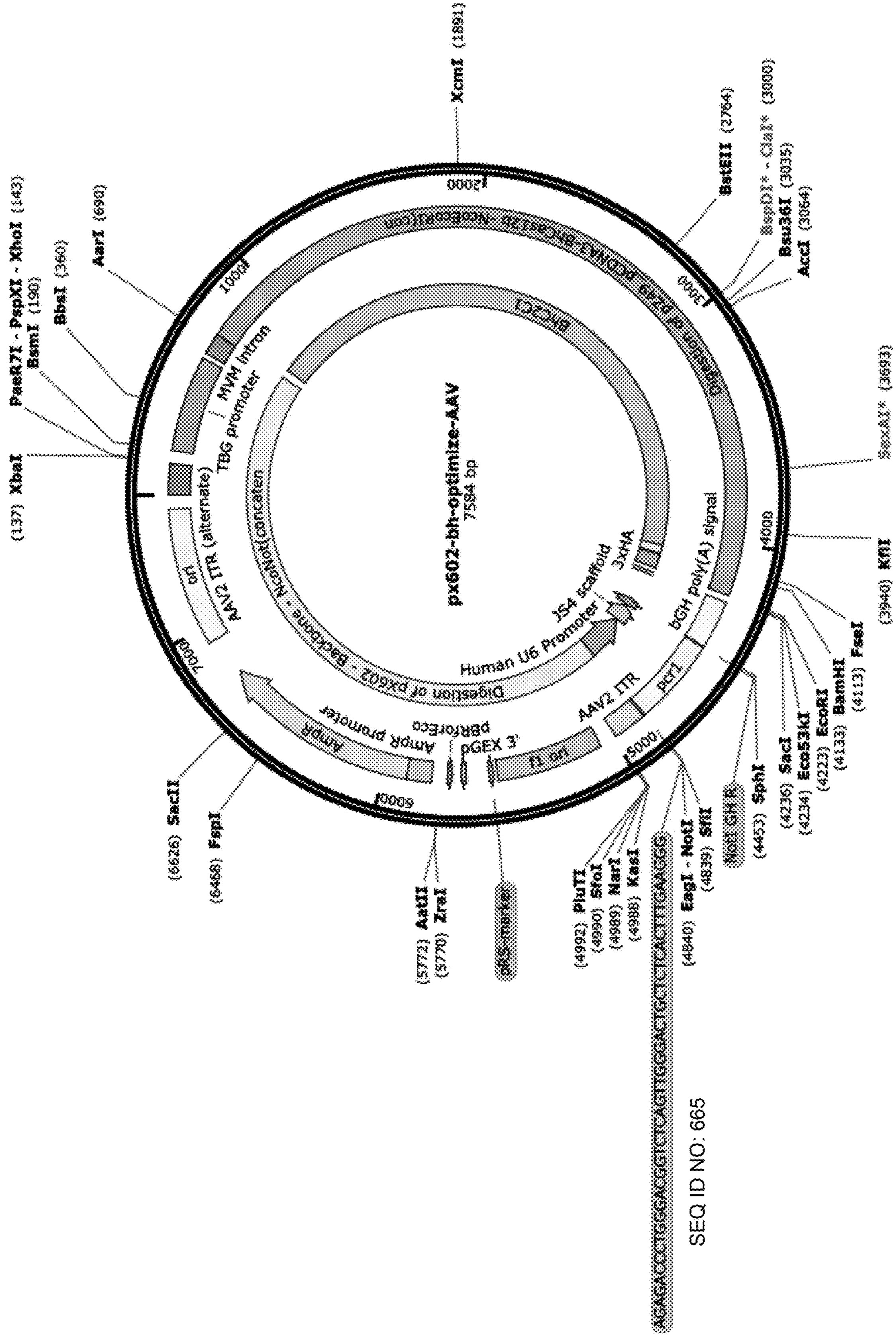
FIGS. 89A-89B—FIG. 89A shows a map of px602-bh-optimize-AAV (SEQ ID NO: 665).
Figure 89B:
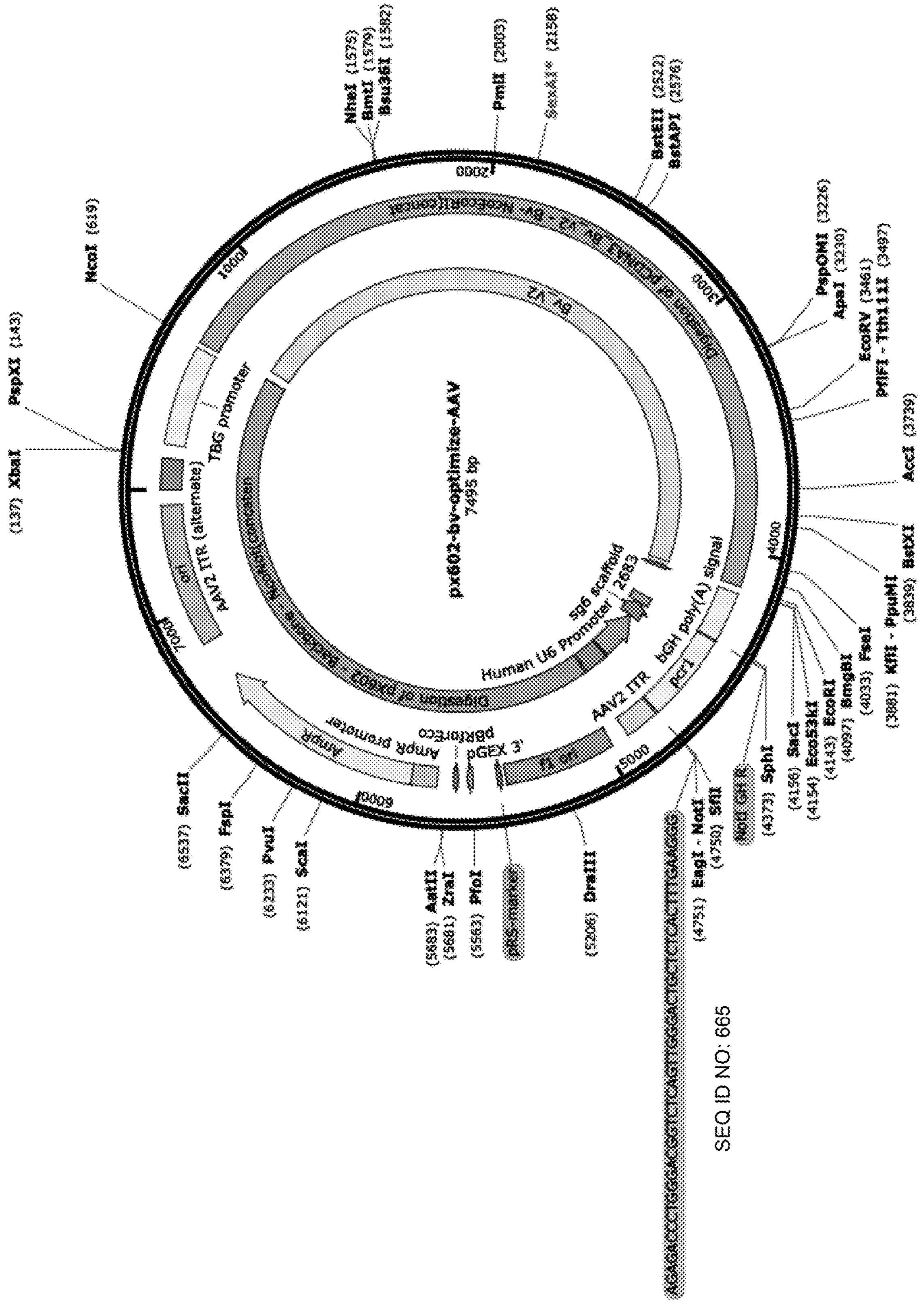

The sequences in this study are shown in Table 33 below. A map of px602-bh-optimize-AAV is shown in FIG. 89A, and a map of px602-bv-optimize-AAV is show in FIG. 89B.

TABLE 33

| Sequence Names | Sequences |
|---|---|
| BhCas12b Mecp2 target (SEQ ID NO: 646): | TACTTTAGAGCGAAAGGCTTTTC |
| BhCas12b Map2 target (SEQ ID NO: 647): | AGATACCAAAGAGAACGGGATCA |
| BvCas12b Mecp2 target (SEQ ID NO: 648): | TGACTTCACTGTAACTGGGAGAG |
| BvCas12b Map2 target (SEQ ID NO: 649): | TCTCCCAGGAAGGGCAGCAGGCT |
| BvCas12b NeuN target (SEQ ID NO: 650): | TAGACGTGGAGATCATTTTTAAC |
| original polyA (SEQ ID NO: 651): | Aataaaatatctttattttcattacatctgtgtgttggttttttgtgtg |
| bGH polyA (optimized construct) (SEQ ID NO: 652): | Ctgtgccttctagttgccagccatctgttgtttgcccctcccccgtgccttccttgaccctggaa ggtgccactcccactgtcctttcctaataaaatgaggaaattgcatcgcattgtctgagtaggtg tcattctattctggggggtggggtggggcaggacagcaagggggaggattgggaagagaatagca ggcatgctgggga |
| NLS-AaCas12b-NLS-3xHA (SEQ ID NO: 653) | MAPKKKRKVGIHGVPAAAVKSMKVKLRLDNMPEIRAGLWKLHTEVNAGVRYYTEWLSLLRQENLY RRSPNGDGEQECYKTAEECKAELLERLRARQVENGHCGPAGSDDELLQLARQLYELLVPQAIGAK GDAQQIARKFLSPLADKDAVGGLGIAKAGNKPRWVRMREAGEPGWEEEKAKAEARKSTDRTADVL RALADFGLKPLMRVYTDSDMSSVQWKPLRKGQAVRTWDRDMFQQAIERMMSWESWNQRVGEAYAK LVEQKSRFEQKNFVGQEHLVQLVNQLQQDMKEASHGLESKEQTAHYLTGRALRGSDKVFEKWEKL DPDAPFDLYDTEIKNVQRRNTRRFGSHDLFAKLAEPKYQALWREDASFLTRYAVYNSIVRKLNHA KMFATFTLPDATAHPIWTRFDKLGGNLHQYTFLFNEFGEGRHAIREQKLLTVEDGVAKEVDDVTV PISMSAQLDDLLPRDPHELVALYFQDYGAEQHLAGEFGGAKIQYRRDQLNHLHARRGARDVYLNL SVRVQSQSEARGERRPPYAAVFRLVGDNHRAFVHFDKLSDYLAEHPDDGKLGSEGLLSGLRVMSV |

TABLE 33-continued

| Sequence Names | Sequences |
|---|---|
| | DLGLRTSASISVFRVARKDELKPNSEGRVPFCFPIEGNENLVAVHERSQLLKLPGETESKDLRAI<br>REERQRTLRQLRTQLAYLRLLVRCGSEDVGRRERSWAKLIEQPMDANQMTPDWREAFEDELQKLK<br>SLYGICGDREWTEAVYESVRRVWRHMGKQVRDWRKDVRSGERPKIRGYQKDVVGGNSIEQIEYLE<br>RQYKFLKSWSFFGKVSGQVIRAEKGSRFAITLREHIDHAKEDRLKKLADRIIMEALGYVYALDDE<br>RGKGKWVAKYPPCQLILLEELSEYQFNNDRPPSENNQLMQWSHRGVFQELLNQAQVHDLLVGTMY<br>AAFSSRFDARTGAPGIRCRRVPARCAREQNPEPFPWWLNKFVAEHKLDGCPLRADDLIPTGEGEF<br>FVSPFSAEEGDFHQIHADLNAAQNLQRRLWSDFDISQIRLRCDWGEVDGEPVLIPRTTGKRTADS<br>YGNKVFYTKTGVTYYERERGKKRRKVFAQEELSEEEAELLVEADEAREKSVVLMRDPSGIINRGD<br>WTRQKEFWSMVNQRIEGYLVKQIRSRVRLQESACENTGDIKRPAATKKAGQAKKKKGSYPYDVPD<br>YAYPYDVPDYAYPYDVPDYA* |
| px602-bh-optimize-AAV<br>(SEQ ID NO: 654) | cctgcaggcagctgcgcgctcgctcgctcactgaggccgcccgggcgtcgggcgacctttggtcg<br>cccggcctcagtgagcgagcgagcgcgcagagagggagtggccaactccatcactaggggttcct<br>gcggcctctagactcgaggggctggaagctacctttgacatcatttcctctgcgaatgcatgtat<br>aatttctacagaacctattagaaaggatcacccagcctctgatttgtacaactttccataaaaaa<br>ctgccaattccactgctgtttggcccaatagtgagaactttttcctgctgcctcttggtgctttt<br>gcctatggcccctattctgcctgctgaagacactatgccagcatggacttaaacccctccagctc<br>tgacaatcctattctcttttgttttacatgaagggtctggcagccaaagcaatcactcaaagttc<br>aaaccttatcatttttttgattgttcctcttggccttggttttgtacatcagctttgaaaatacca<br>tcccagggttaatgctggggttaatttataactaagagtgctctagttttgcaatacaggacatg<br>ctataaaaatggaaagataccggtgccacAAGAGGTAAGGGTTTAAGGGATGGTTGGTTGGTGGG<br>GTATTAATGTTTAATTACCTGGAGCACCTGCCTGAAATCACTTTTTTTCAGGTTGGcatggcccc<br>aaagaagaagcggaaggtcggtatccacggagtcccagcagccgccaccagatccttcatcctga<br>agatcgagcccaacgaggaagtgaagaaaggcctctggaaaacccacgaggtgctgaaccacgga<br>atcgcctactacatgaatatcctgaagctgatccggcaagaggccatctacgagcaccacgagca<br>ggaccccaagaatcccaagaaggtgtccaaggccgagatccaggccgagctgtgggatttcgtgc<br>tgaagatgcagaagtgcaacagatcacacacgaggtggacaaggacgaggtgttcaacatcctga<br>gagagctgtacgaggaactggtgcccagcagcgtggaaaagaagggcgaagccaaccagctgagc<br>aacaagtttctgtaccctctggtggaccccaacagccagtctggaaagggaacagccagcagcgg<br>cagaaagcccagatggtacaacctgaagattgccggcgatccctcctgggaagaagagaagaaga<br>agtgggaagaagataagaaaaaggacccgctggccaagatcctgggcaagctggctgagtacgga<br>ctgatccctctgttcatcccctacaccgacagcaacgagcccatcgtgaaagaaatcaagtggat<br>ggaaaagtcccggaaccagagcgtgcggcggctggataaggacatgttcattcaggccctggaac<br>ggttcctgagctgggagagctggaacctgaaagtgaaagaggaatacgagaaggtcgagaaagag<br>tacaagaccctggaagagaggatcaaagaggacatccaggctctgaaggctctggaacagtatga<br>gaaagagcggcaagaacagctgctgcgggacaccctgaacaccaacgagtaccggctgagcaaga<br>gaggccttagaggctggcgggaaatcatccagaaatggctgaaaatggacgagaacgagccctcc<br>gagaagtacctggaagtgttcaaggactaccagcggaagcaccctagagaggccggcgattacag<br>cgtgtacgagttcctgtccaagaaagagaaccacttcatctggcggaatcaccctgagtacccct<br>acctgtacgccaccttctgcgagatcgacaagaaaaagaaggacgccaagcagcaggccaccttc<br>acactggccgatcctatcaatcaccctctgtgggtccgattcgaggaaagaagcggcagcaacct<br>gaacaagtacagaatcctgaccgagcagctgcacaccgagaagctgaagaaaaagctgacagtgc<br>agctggaccggctgatctaccctacagaatctggcggctgggaagagaagggcaaagtggacatt<br>gtgctgctgcccagccggcagttctacaaccagatcttcctggacatcgaggaaaagggcaagca<br>cgccttcacctacaaggatgagagcatcaagttccctctgaagggcacactcggcggagccagag<br>tgcagttcgacagagatcacctgagaagataccctcacaaggtggaaagcggcaacgtgggcaga<br>atctacttcaacatgaccgtgaacatcgagcctacagagtccccagtgtccaagtctctgaagat<br>ccaccgggacgacttccccaaggtggtcaacttcaagcccaaagaactgaccgagtggatcaagg<br>acagcaagggcaagaaactgaagtccggcatcgagtccctggaaatcggcctgagagtgatgagc<br>atcgacctgggacagagacaggccgctgccgcctctatttcgaggtggtggatcagaagcccga<br>catcgaaggcaagctgtttttcccaatcaagggcaccgagctgtatgccgtgcacagagccagat<br>caacatcaagctgcccggcgagacactggtcaagagcagagaagtgctgcggaaggccagagagg<br>acaatctgaaactgatgaaccagaagctcaacttcctgcggaacgtgctgcacttccagcagttc<br>gaggacatcaccgagagagagaagcgggtcaccaagtggatcagcagacaagagaacagcgacgt<br>gcccctggtgtaccaggatgagctgatccagatccgcgagctgatgtacaagccttacaaggact<br>gggtcgccttcctgaagcagctccacaagagactggaagtcgagatcggcaaagaagtgaagcac<br>tggcggaagtccctgagcgacggaagaaagggcctgtacggcatctccctgaagaacatcgacga<br>gatcgatcggacccggaagttcctgctgagatggtccctgaggcctaccgaacctggcgaagtgc<br>gtagactggaacccggccagagattcgccatcgaccagctgaatcacctgaacgccctgaaagaa<br>gatcggctgaagaagatggccaacaccatcatcatgcacgccctgggctactgctacgacgtgcg<br>gaagaagaaatggcaggctaagaaccccgcctgccagatcatcctgttcgaggatctgagcaact<br>acaacccctacgaggaaaggtcccgcttcgagaacagcaagctcatgaagtggtccagacgcgag<br>atccccagacaggttgcactgcagggcgagatctatggcctgcaagtgggagaagtgggcgctca<br>gttcagcagcagattccacgccaagacaggcagccctggcatcagatgtagcgtcgtgaccaaag<br>agaagctgcaggacaatcggttcttcaagaatctgcagagagagggcagactgaccctggacaaa<br>atcgccgtgctgaaagagggcgatctgtacccagacaaaggcggcgagaagttcatcagcctgag<br>caaggatcggaagtgcgtgaccacacacgccgacatcaacgccgctcagaacctgcagaagcggt<br>tctggacaagaacccacggcttctacaaggtgtactgcaaggcctaccaggtggacggccagacc<br>gtgtacatccctgagagcaaggaccagaagcagaagatcatcgaagagttcggcgagggctactt<br>cattctgaaggacggggtgtacgaatgggtcaacgccggcaagctgaaaatcaagaagggcagct<br>ccaagcagagcagcagcgagctggtggatagcgacatcctgaaagacagcttcgacctggcctcc<br>gagctgaaaggcgaaaagctgatgctgtacagggaccccagcggcaatgtgttccccagcgacaa<br>atggatggccgctggcgtgttcttcggaaagctggaacgcatcctgatcagcaagctgaccaacc<br>agtactccatcagcaccatcgaggacgacagcagcaagcagtctatgaaaaggccggcggccacg<br>aaaaaggccggccaggcaaaaaagaaaaagggatcctacccatacgatgttccagattacgctta<br>tccctacgacgtgcctgattatgcatacccatatgatgtccccgactatgcctaagaattcctag<br>agctcgctgatcagcctcgactgtgccttctagttgccagccatctgttgtttgcccctcccccg<br>tgccttccttgaccctggaaggtgccactcccactgtcctttcctaataaaatgaggaaattgca |

TABLE 33-continued

| Sequence Names | Sequences |
| --- | --- |
| | tcgcattgtctgagtaggtgtcattctattctggggggtggggtggggcaggacagcaagggggga<br>ggattgggaagagaatagcaggcatgctggggacggccaaaaaaagagaccatatatggtctccg<br>tgctaatgcctcgtaagagacatcgtccagcaataggagtttctcacaccctgcagcacttatag<br>ctagacggttgtcctgaccaaaagacagaaccggtgtttcgtcctttccacaagatatataaagc<br>caagaaatcgaaatactttcaagttacggtaagcatatgatagtccattttaaaacataattta<br>aaactgcaaactacccaagaaattattactttctacgtcacgtattttgtactaatatctttgtg<br>tttacagtcaaattaattccaattatctctctaacagccttgtatcgtatatgcaaatatgaagg<br>aatcatgggaaataggccctcgcggccgcaggaacccctagtgatggagttggccactccctctc<br>tgcgcgctcgctcgctcactgaggccgggcgaccaaaggtcgcccgacgcccgggctttgcccgg<br>gcggcctcagtgagcgagcgagcgcgcagctgcctgcaggggcgcctgatgcggtattttctcct<br>tacgcatctgtgcggtatttcacaccgcatacgtcaaagcaaccatagtacgcgccctgtagcgg<br>cgcattaagcgcggcgggtgtggtggttacgcgcagcgtgaccgctacacttgccagcgccctag<br>cgcccgctcctttcgctttcttcccttcctttctcgccacgttcgccggctttccccgtcaagct<br>ctaaatcgggggctccctttagggttccgatttagtgctttacggcacctcgaccccaaaaaact<br>tgatttgggtgatggttcacgtagtgggccatcgccctgatagacggtttttcgccctttgacgtt<br>ggagtccacgttctttaatagtggactcttgttccaaactggaacaacactcaaccctatctcgg<br>gctattcttttgatttataagggattttgccgatttcggcctattggttaaaaaatgagctgatt<br>taacaaaaatttaacgcgaattttaacaaaatattaacgtttacaattttatggtgcactctcag<br>tacaatctgctctgatgccgcatagttaagccagccccgacacccgccaacacccgctgacgcgc<br>cctgacgggcttgtctgctcccggcatccgcttacagacaagctgtgaccgtctccgggagctgc<br>atgtgtcagaggttttcaccgtcatcaccgaaacgcgcgagacgaaagggcctcgtgatacgcct<br>atttttataggttaatgtcatgataataatggtttcttagacgtcaggtggcacttttcggggaa<br>atgtgcgcggaacccctatttgtttatttttctaaatacattcaaatatgtatccgctcatgaga<br>caataaccctgataaatgatcaataatattgaaaaaggaagagtatgagtattcaacatttccgt<br>gtcgcccatattccattttttgcggcattttgccttcctgtttttgctcacccagaaacgctggtga<br>aagtaaaagatgctgaagatcagttgggtgcacgagtgggttacatcgaactggatctcaacagc<br>ggtaagatccttgagagttttcgccccgaagaacgttttccaatgatgagcacttttaaagttct<br>gctatgtggcgcggtattatcccgtattgacgccgggcaagagcaactcggtcgccgcatacact<br>attctcagaatgacttggttgagtactcaccagtcacagaaaagcatcttacggatggcatgaca<br>gtaagagaattatgcagtgctgccataaccatgagtgataacactgcggccaacttacttctgac<br>aacgatcggaggaccgaaggagctaaccgcttttttgcacaacatgggggatcatgtaactcgcc<br>ttgatcgttgggaaccggagctgaatgaagccataccaaacgacgagcgtgacaccacgatgcct<br>gtagcaatggcaacaacgttgcgcaaactattaactggcgaactacttactctagatcccggcaa<br>caattaatagactggatggaggcggataaagttgcaggaccacttctgcgctcggccatccggct<br>ggctggtttattgctgataaatctggagccggtgagcgtggaagccgcggtatcattgcagcact<br>ggggccagatggtaagccctcccgtatcgtagttatctacacgacggggagtcaggcaactatgg<br>atgaacgaaatagacagatcgctgagataggtgcctcactgattaagcattggtaactgtcagac<br>caagtttactcatatatactttagattgatttaaaacttcatttttaatttaaaaggatctaggt<br>gaagatcctttttgataatctcatgaccaaaatcccttaacgtgagttttcgttccactgagcgt<br>cagaccccgtagaaaagatcaaaggatcttatgagatcctttttttctgcgcgtaatctgctgat<br>gcaaacaaaaaaaccaccgctaccagcggtggtttgtttgccggatcaagagctaccaactattt<br>tccgaaggtaactggcttcagcagagcgcagataccaaatactgtccttctagtgtagccgtagt<br>taggccaccacttcaagaactctgtagcaccgcctacatacctcgctctgctaatcctgttacca<br>gtggctgctgccagtggcgataagtcgtgtataccgggttggactcaagacgatagttaccggat<br>aaggcgcagcggtcgggctgaacggggggttcgtgcacacagcccagcttggagcgaacgaccta<br>caccgaactgagatacctacagcgtgagctatgagaaagcgccacgcttcccgaagggagaaagg<br>cggacaggtatccggtaagcggcagggtcggaacaggagagcgcacgagggagatccagggggaa<br>acgcctggtatctttatagtcctgtcgggtttcgccacctctgacttgagcgtcgatttttgtga<br>tgctcgtcaggggggcggagcctatggaaaaacgccagcaacgcggcctttttacggttcctggc<br>cttttgctggccttttgctcacatgt |
| px602-bv-optimize-AAV<br>(SEQ ID NO: 655) | cctgcaggcagctgcgcgctcgctcgctcactgaggccgcccgggcgtcgggcgacctttggtcg<br>cccggcctcagtgagcgagcgagcgcgcagagagggagtggccaactccatcactaggggttcct<br>gcggcctctagactcgaggggctggaagctacctttgacatcatttcctctgcgaatgcatgtat<br>aatttctacagaacctattagaaaggatcacccagcctctgatttgtacaactttccataaaaaa<br>ctgccaattccactgctgtttggcccaatagtgagaactttttcctgctgcctcttggtgatttg<br>cctatggcccctattctgcctgctgaagacactatgccagcatggacttaaacccctccagctct<br>gacaatcctctttctcttttgttttacatgaagggtctggcagccaaagcaatcactcaaagttc<br>aaaccttatcatttttttgattgttcctcttggccttggttttgtacatcagctttgaaaatacca<br>tcccagggttaatgctggggttaatttataactaagagtgctctagttttgcaatacaggacatg<br>ctataaaaatggaaagataccggtgccaccatggccccaaagaagaagcggaaggtcggtatcca<br>cggagtcccagcagccgccatccggtccatcaagctgaagatgaagaccaacagcggcaccgaca<br>gcatctacctgagaaaagccctgtggcggacccaccagctgatcaatgagggaatcgcctactac<br>atgaacctgctgaccctgtaccggcaagaggccatcggcgacaagaccaaagaagcctatcaggc<br>cgagctgattaacatcatccggaaccagcagcggaacaacggcagctctgaggaacacggctccg<br>accaagaaattctggccctgctgagacagctgtacgagctgatcatccccagcagcatcggcgaa<br>tctggcgacgctaatcagctgggcaacaagtttctgtaccctctggtggaccccaacagccagtc<br>tggcaagggcacatctaacgccggcagaaagcccagatggaagcggctgaaagaggaaggcaacc<br>ccgactgggaactcgagaagaagaaggacgaggaacgcaaggccaaggatcccaccgtgaagatc<br>tttgacaacctgaacaaatacggcctgctgcctctgttcccactgttcaccaacatccagaaaga<br>catcgagtggctgcccctgggcaagagacagtctgtgcggaagtgggacaaagacatgttcatcc<br>aggccatcgagagactgctgagctgggagagctggaacagaagagtggccgacgagtacaaacag<br>ctgaaagaaaagaccgagagctactacaaagagcacctgacaggcggcgaggaatggatcgagaa<br>gatccggaagttcgagaaagaacggaacatggaactggaaaagaacgccttcgctcccaacgacg<br>gctacttcatcaccagcagacagatcagaggctgggacagagtgtacgagaagtggtccaagctg<br>cccgagtctgctagccctgaggaactgtggaaagtggtggccgagcagcagaacaagatgtccga<br>aggcttcggcgaccccaaggtgttcagcttcctggccaacagagagaaccgggacatttggagag<br>gccacagcgagcggatctaccacattgccgcctacaacggcctgcagaagaagctgagccggacc |

TABLE 33-continued

| Sequence Names | Sequences |
| --- | --- |
| | aaagagcaggccaccttcacactgcctgacgccattgaacaccctctgtggatcagatacgagag |
| | ccctggcggcaccaacctgaatctgttcaagctggaagagaaacagaaaaagaactactacgtga |
| | ccctgagcaagatcatctggcccagcgaggaaaagtggattgagaaagagaacatcgagatccct |
| | ctggctcccagcatccagttcaaccggcagattaagctgaagcagcacgtgaagggcaagcaaga |
| | gatcagcttcagcgactacagcagccggatcagcctggatggtgttctcggcggcagcagaatcc |
| | agtttaatcggaagtacatcaagaaccacaaagagctgctcggagagggcgacatcggccccgtg |
| | ttctttaacctggtggtggatgtggcccctctgcaagaaaccagaaacggcagactgcagagccc |
| | catcggcaaggccctgaaagtgatcagcagcgacttctccaaagtgatcgactacaagccgaaag |
| | aactcatggattggatgaataccggcagcgccagcaacagctttggagtggcttctctgctggaa |
| | ggcatgagagtgatgagcatcgacatgggccagagaaccagcgcctccgtgtccatcttcgaggt |
| | cgtgaaagaactgcccaaggatcaagagcagaagctgttctacagcatcaacgacaccgagctgt |
| | tcgccatccacaagcggagctttctgctgaacctgcctggcgaggtggtcaccaagaacaacaag |
| | cagcagcggcaagagcggcggaaaaagcggcagtttgtgcggagccagatcagaatgctggccaa |
| | cgtgctgcggctggaaacaaagaaaacccctgacgagcggaagaaggccattcacaagctgatgg |
| | aaatcgtgcagagctacgacagctggaccgccagccagaaagaagtgtgggagaaagagctgaat |
| | ctcctgaccaacatggccgccttcaatgacgagatctggaaagaaagcctggtggaactgcacca |
| | ccggatcgagccttacgtgggacagatcgtgtccaagtggcggaagggcctgtctgagggcagaa |
| | agaatctggccggcatcagcatgtggaacatcgacgaactggaagataccaggcggctgctgatt |
| | tcctggtccaagagaagcagaaccccaggcgaggccaacaggatcgaaaccgatgagcctttcgg |
| | cagcagcctgctccagcacattcagaacgtgaaggacgacagactgaagcagatggccaacctga |
| | tcatcatgacagccctgggctttaagtacgacaaagaggaaaaggaccggtacaagcggtggaaa |
| | gagacataccccgcctgccagatcatcctgttcgagaacctgaaccgctacctgttcaacctcga |
| | ccggtccagacgcgagaacagcagactgatgaagtgggcccatcggagcatccccagaaccgtgt |
| | ctatgcagggcgagatgttcggcctgcaagtgggcgacgttcggagcgagtacagctccagattc |
| | cacgccaaaacaggcgcccctggcatcagatgtcacgccctgactgaagaggatctgaaggccgg |
| | cagcaacaccctgaagagactgatcgaggacggcttcatcaatgagagcgagctggcctacctga |
| | agaagggcgatatcatccctagccaaggcggcgaactgttcgtgacactgtccaagcggtacaag |
| | aaggacagcgacaacaacgagctgaccgtgatccacgccgacatcaacgccgctcagaatctgca |
| | gaagcggttttggcagcaaaacagcgaggtgtacagagtgccctgtcagctggccagaatgggcg |
| | aagataagctgtacatccccaagagccagaccgagacaatcaagaagtatttcggcaagggctcc |
| | ttcgtgaagaacaataccgaacaagaggtctacaagtgggagaagtccgagaaaatgaagatcaa |
| | gacggacaccaccttcgacctgcaagacctggatggcttcgaggacatcagcaagaccattgagc |
| | tggcacaagagcagcaaaagaaatacctgaccatgttcagggaccccagcggctactttttcaac |
| | aatgagacatggcggcctcaaaaagaatactggtccatcgtgaacaacatcatcaagagctgcct |
| | caagaagaagatcctgagcaacaaggtcgagctgaaaaggccggcggccacgaaaaaggccggcc |
| | aggcaaaaaagaaaaagggatcctacccatacgatgttccagattacgcttatccctacgacgtg |
| | cctgattatgcataccctatgatgtccccgactatgcctaagaattcctagagctcgctgatca |
| | gcctcgactgtgccttctagttgccagccatctgttgtttgcccctcccccgtgccttccttgac |
| | cctggaaggtgccactcccactgtcctttcctaataaaatgaggaaattgcatcgcattgtctga |
| | gtaggtgtcattctattctggggggtggggtggggcaggacagcaagggggaggattgggaagag |
| | aatagcaggcatgctggggacggccaaaaaaaagagaccatatatggtctccgtgccaagcacctg |
| | ttttcaggtgctcctgtggtgggtaatttttaattacttatggcacacgcacacagattcattgacc |
| | ctataggtccggtgtttcgtcctttccacaagatatataaagccaagaaatcgaaatactttcaa |
| | gttacggtaagcatatgatagtccattttaaaacataattttaaaactgcaaactacccaagaaa |
| | ttattactttctacgtcacgtattttgtactaatatctttgtgtttacagtcaaattaattccaa |
| | ttatctctctaacagccttgtatcgtatatgcaaatatgaaggaatcatgggaaataggccctcg |
| | cggccgcaggaacccctagtgatggagttggccactccctctctgcgcgctcgctcgctcactga |
| | ggccgggcgaccaaaggtcgcccgacgcccgggctttgcccgggcggcctcagtgagcgagcgag |
| | cgcgcagctgcctgcaggggcgcctgatgcggtattttctccttacgcatctgtgcggtatttca |
| | caccgcatacgtcaaagcaaccatagtacgcgccctgtagcggcgcattaagcgcggcgggtgtg |
| | gtggttacgcgcagcgtgaccgctacacttgccagcgccctagcgcccgctcctttcgctttctt |
| | cccttcctttctcgccacgttcgccggctttccccgtcaagctctaaatcgggggctccdttagg |
| | gttccgatttagtgctttacggcacctcgaccccaaaaaacttgatttgggtgatggttcacgta |
| | gtgggccatcgccctgatagacggtttttcgccctttgacgttggagtccacgttctttaatagt |
| | ggactcttgttccaaactggaacaacactcaaccctatctcgggctattcttttgatttataagg |
| | gattttgccgatttcggcctattggttaaaaaatgagctgatttaacaaaaatttaacgcgaatt |
| | ttaacaaaatattaacgtttacaattttatggtgcactctcagtacaatctgctctgatgccgca |
| | tagttaagccagccccgacacccgccaacacccgctgacgcgccctgacgggcttgtctgctccc |
| | ggcatccgcttacagacaagctgtgaccgtctccgggagctgcatgtgtcagaggttttcaccgt |
| | catcaccgaaacgcgcgagacgaaagggcctcgtgatacgcctatttttataggttaatgtcatg |
| | ataataatggtttcttagacgtcaggtggcacttttcggggaaatgtgcgcggaacccctatttg |
| | tttatttttctaaatacattcaaatatgtatccgctcatgagacaataaccctgataaatgcttc |
| | aataatattgaaaaaggaagagtatgagtattcaacatttccgtgtcgcccttattcccttttt |
| | gcggcattttgccttcctgtttttgctcacccagaaacgctggtgaaagtaaaagatgctgaaga |
| | tcagttgggtgcacgagtgggttacatcgaactggatctcaacagcggtaagatccttgagagtt |
| | ttcgccccgaagaacgttttccaatgatgagcacttttaaagttctgctatgtggcgcggtatta |
| | tcccgtattgacgccgggcaagagcaactcggtcgccgcatacactattctcagaatgacttggt |
| | tgagtactcaccagtcacagaaaagcatcttacggatggcatgacagtaagagaattatgcagtg |
| | ctgccataaccatgagtgataacactgcggccaacttacttctgacaacgatcggaggaccgaag |
| | gagctaaccgcttttttgcacaacatgggggatcatgtaactcgccttgatcgttgggaaccgga |
| | gctgaatgaagccataccaaacgacgagcgtgacaccacgatgcctgtagcaatggcaacaacgt |
| | tgcgcaaactattaactggcgaactacttactctagcttcccggcaacaattaatagactggatg |
| | gaggcggataaagttgcaggaccacttctgcgctcggcccttccggctggctggtttattgctga |
| | taaatctggagccggtgagcgtggaagccgcggtatcattgcagcactggggccagatggtaagc |
| | cctcccgtatcgtagttatctacacgacggggagtcaggcaactatggatgaacgaaatagacag |
| | atcgctgagataggtgcctcactgattaagcattggtaactgtcagaccaagtttactcatatat |
| | actttagattgatttaaaacttcatttttaatttaaaaggatctaggtgaagatcctttttgata |
| | atctcatgaccaaaatcccttaacgtgagttttcgttccactgagcgtcagaccccgtagaaaag |

TABLE 33-continued

| Sequence Names | Sequences |
|---|---|
| | atcaaaggatcttcttgagatcctttttttctgcgcgtaatctgctgcttgcaaacaaaaaaacc accgctaccagcggtggtttgtttgccggatcaagagctaccaactctttttccgaaggtaactg gcttcagcagagcgcagataccaaatactgtccttctagtgtagccgtagttaggccaccacttc aagaactctgtagcaccgcctacatacctcgctctgctaatcctgttaccagtggctgctgccag tggcgataagtcgtgtcttaccgggttggactcaagacgatagttaccggataaggcgcagcggt cgggctgaacggggggttcgtgcacacagcccagcttggagcgaacgacctacaccgaactgaga tacctacagcgtgagctatgagaaagcgccacgcttcccgaagggagaaaggcggacaggtatcc ggtaagcggcagggtcggaacaggagagcgcacgagggagcttccagggggaaacgcctggtatc tttatagtcctgtcgggtttcgccacctctgacttgagcgtcgatttttgtgatgctcgtcaggg gggcggagcctatggaaaaacgccagcaacgcggcctttttacggttcctggccttttgctggcc ttttgctcacatgt |

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

4. The system of claim 1, wherein the guide sequence hybridizes to one or more target sequences in a prokaryotic cell, or in a eukaryotic cell.

5. The system of claim 1, wherein the system further comprises an engineered adenosine deaminase coupled to the Cas12b effector protein.

6. The system of claim 5, wherein the engineered adenosine deaminase further comprises one or more mutations relative to an hADAR2 selected from E488, V351, S486, T375, S370, P462, N597, L332, I398, K350, D619, S582, V440, S495, K418, and S661, or a mutation corresponding thereto in a homologue of hADAR2; or further comprises a polynucleotide encoding an engineered adenosine deaminase comprising one or more mutations relative to an hADAR2 selected from E488Q, V351G, S486A, T375S, S370C, P462A, N597I, L332I, I398V, K350I, D619G, S582T, V440I, S495N, K418E, and S661T, or a mutation corresponding thereto in a homologue of hADAR2.

SEQUENCE LISTING (665 sequences)

SEQ ID NO: 1 - RNA, 188 nt, Artificial Sequence
  Synthetic Oligonucleotide
cgccuaucagccaacaugcucgcuuugcgaaggcugacggcccgcucucauuuggcauugccgggagccggaguuuucggaagagagugucgacgacugcugaucuccgcauccgcguccuguucgccaggccgggucggguguacggaucaugcuggcagcagucuacgccgagaacauucgcuuuu

SEQ ID NO: 2 - RNA, 60 nt, Artificial Sequence
  Synthetic Oligonucleotide
cggaagagagugucgacgacugcugaucuccgcauccgcguccuguucgccaggccgggu

SEQ ID NO: 3 - RNA, 62 nt, Artificial Sequence
  Synthetic Oligonucleotide
ccaacaugcucgcuuugcgaaggcugacggcccgcucucauuuggcauugccgggagccgga

SEQ ID NO: 4 - RNA, 118 nt, Artificial Sequence
  Synthetic Oligonucleotide
ucgcuuugcgaaggcugacggcccgcucucauuuggcauugccgggagccggaguuuucggaagagagugucgacgacugcugaucuccgcauccgcguccuguucgccaggccgggu

SEQ ID NO: 5 - RNA, 87 nt, Artificial Sequence
  Synthetic Oligonucleotide
augcucgcuuugcgaaggcugacggcccgcucucauuuggcauugccgggagccggaguuuucggaagagagugucgacgacugcug

SEQ ID NO: 6 - RNA, 71 nt, Artificial Sequence
  Synthetic Oligonucleotide
aguuuucggaagagagugucgacgacugcugaucuccgcauccgcguccuguucgccaggccgggucgggu

SEQ ID NO: 7 - RNA, 61 nt, Artificial Sequence
  Synthetic Oligonucleotide
cgccuaucagccaacaugcucgcuuugcgaaggcugacggcccgcucucauuuggcauugc

SEQ ID NO: 8 - RNA, 87 nt, Artificial Sequence
  Synthetic Oligonucleotide
cgccuaucagccaacaugcucgcuuugcgaaggcugacggcccgcucucauuuggcauugccgggagccggaguuuucggaagagag

SEQ ID NO: 9 - RNA, 84 nt, Artificial Sequence
  Synthetic Oligonucleotide
ugaucuccgcauccgcguccuguucgccaggccgggucggguguacggaucaugcuggcagcagucuacgccgagaacauucgc

SEQ ID NO: 10 - RNA, 91 nt, Artificial Sequence
  Synthetic Oligonucleotide
auugccgggagccggaguuuucggaagagagugucgacgacugcugaucuccgcauccgcguccuguucgccaggccgggucggguguacg

SEQ ID NO: 11 - DNA, 83 bp, Artificial Sequence
  Synthetic Oligonucleotide
tccgcatccgcgtcctgttcgccaggccgggtcgggtgtacggatcatgctggcagcagtctacgccgagaacattcgctttt

SEQ ID NO: 12 - RNA, 60 nt, Artificial Sequence; identical to SEQ ID NO: 2
  Synthetic Oligonucleotide

SEQ ID NO: 13 - RNA, 85 nt, Artificial Sequence
  Synthetic Oligonucleotide
aguuuucggaagagagugucgacgacugcugaucuccgcauccgcguccuguucgccaggccgggucggguccgcgaauggacac

SEQ ID NO: 14 - DNA, 129 bp, Artificial Sequence
  Synthetic Oligonucleotide
tagggaatattatataatggacttacgaggttctgtcttttggtcaggacaaccgtctagctataagtgctgcagggtgtgagaaactcctattgctggacgatgtctcttgatacgaggcattagcac

SEQ ID NO: 15 - DNA, 75 bp, Artificial Sequence
  Synthetic Oligonucleotide
gacgtctagctataagtgctgcagggtgtgagaaactcctattgctggacgatgtctcttacgaggcattagcac

SEQ ID NO: 16 - DNA, 106 bp, Artificial Sequence
  Synthetic Oligonucleotide
acgaggttctgtcttttggtcaggacaaccgtctagctataagtgctgcagggtgtgagaaactcctattgctggacgatgtctctatgatacgaggcattagcac

SEQ ID NO: 17 - DNA, 133 bp, Artificial Sequence
  Synthetic Oligonucleotide
acgaggttctgtcttttggtcaggacaaccgtctagctataagtgctgcagggtgtgagaaactcctattgctggacgatgtctcttttatttcttttttgtagaaaaaagaaatgatacgaggcattagcac

SEQ ID NO: 18 - DNA, 97 bp, Artificial Sequence
  Synthetic Oligonucleotide
gttctgtcttttggtcaggacaaccgtctagctataagtgctgcagggtgtgagaaactcctattgctggacgatatctcttacgaggcattagcac

SEQ ID NO: 19 - DNA, 84 bp, Artificial Sequence
  Synthetic Oligonucleotide
gtcaggacaaccgtctagctataagtgctgcagggtgtgagaaactcctattgctggacgatgtctcttacgaggcattagcac

SEQ ID NO: 20 - DNA, 108 bp, Artificial Sequence
  Synthetic Oligonucleotide
ggacttacgaggttctgtcttttggtcaggacaaccgtctagctataagtgctgcagggtgtgagaaactcctattgctggacgatgtctcttacgaggcattagcac

SEQ ID NO: 21 - DNA, 102 bp, Artificial Sequence
  Synthetic Oligonucleotide
acgaggttctgtcttttggtcaggacaaccgtctagctataagtgctgcagggtgtgagaaactcctattgctggacgatgtctcttacgaggcattagcac

SEQ ID NO: 22 - DNA, 129 bp, Artificial Sequence
  Synthetic Oligonucleotide
tagggaatattatataatggacttacgaggttctgtcttttggtcaggacaaccgtctagctataagtgctgcagggtgtgagaaactcctattgctggacgatgtctctttatacgaggcattagcac

SEQ ID NO: 23 - DNA, 121 bp, Artificial Sequence
  Synthetic Oligonucleotide
attatatattggacttacgaggttctgtcttttggtcaggacaaccgtctagctataagtgctgcagggtgtgagaaactcctattgctggacgatgtctctttatacgaggcattagcac

SEQ ID NO: 24 - DNA, 113 bp, Artificial Sequence
  Synthetic Oligonucleotide
atggacttacgaggttctgtcttttggtcaggacaaccgtctagctataagtgctgcagggtgtgagaaactcctattgctggacgatgtctctttatacgaggcattagcac

SEQ ID NO: 25 - DNA, 105 bp, Artificial Sequence
  Synthetic Oligonucleotide
acgaggttctgtcttttggtcaggacaaccgtctagctataagtgctgcagggtgtgagaaactcctattgctggacgatgtctctttatacgaggcattagcac

SEQ ID NO: 26 - DNA, 160 bp, Artificial Sequence
  Synthetic Oligonucleotide
tagggaatattatataatggacttacgaggttctgtcttttggtcaggacaaccgtctagctataagtgctgcagggtgtgagaaactcctattgctggacgatgtctcatttatttcttaattgtccaagaattaagaaatgatacgaggcattagcac

SEQ ID NO: 27 - DNA, 152 bp, Artificial Sequence
  Synthetic Oligonucleotide
attatataatggacttacgaggttctgtcttttggtcaggacaaccgtctagctataagtgctgcagggtgtgagaaactcctattgctggacgatgtctcatttatttcttaattgtccaagaattaagaaatgatacgaggcattagcac

SEQ ID NO: 28 - DNA, 144 bp, Artificial Sequence
  Synthetic Oligonucleotide
atggacttacgaggttctgtcttttggtcaggacaaccgtctagctataagtgctgcagggtgtgagaaactcctattgctggacgatgtctcatttatttcttaattgtccaagaattaagaaatgatacgaggcattagcac

SEQ ID NO: 29 - DNA, 136 bp, Artificial Sequence
  Synthetic Oligonucleotide
acgaggttctgtcttttggtcaggacaaccgtctagctataagtgctgcagggtgtgagaaactcctattgctggacgatgtctcatttatttcttaattgtccaagaattaagaaatgatacgaggcattagcac

SEQ ID NO: 30 - DNA, 80 bp, Artificial Sequence
  Synthetic Oligonucleotide
tttgcctaaagggcaaagaatactgtgcgtgtgctaaggatggaaaaaatccattcaaccacaggattacattatttatc

SEQ ID NO: 31 - DNA, 89 bp, Artificial Sequence
  Synthetic Oligonucleotide
gtcgtctataggacggcgaggacaacgggaactgccaatgtgctctttccaagagcaaacaccccgttggcttcaagatgaccgctcgc

SEQ ID NO: 32 - DNA, 78 bp, Artificial Sequence
  Synthetic Oligonucleotide
gacctatagggtcaatgaatctgtgcgtgtgccataagtaattaaaaattacccaccacaggattatcttatttctgc

SEQ ID NO: 33 - RNA, 97 nt, Artificial Sequence
  Synthetic Oligonucleotide
uggcaacucgcccgcuaguacaacuucgguugccccacaagugaggaccuuucucacguaaccguguagggcaacuuagacggcaggauaucuagcc

SEQ ID NO: 34 - RNA, 97 nt, Artificial Sequence
  Synthetic Oligonucleotide
uggcaacucgcccgcuaguacaacuucgguugccccacaagugaggaccuuucucacguaaccguguagggcaacuuagacgccaggauaucuagcc

SEQ ID NO: 35 - RNA, 138 nt, Artificial Sequence
  Synthetic Oligonucleotide
gccgaucuauaggacggcagauucaacgggaugugccaaugcacucuuuccaggagugaacaccccguuggcuucaacaugaucgcccgcucaacggucccuagucggaucguugagcgggcgaucugagaagggcac

SEQ ID NO: 36 - RNA, 128 nt, Artificial Sequence
  Synthetic Oligonucleotide
cacggugaagagucuagcgggcgaguugcaucgcaacucgcccgcuaguacaacuucgguugccccacaagugaggaccuuucucacguaaccguguagggcaacuuagaccgcaggauaucuagccg

SEQ ID NO: 37 - RNA, 112 nt, Artificial Sequence
  Synthetic Oligonucleotide
cacggugaagagucuagcgggauccccgcuaguacaacuucgguugccccacaagugaggaccuuucucacguaaccguguagggcaacuuagacggcaggauaucuagccg

SEQ ID NO: 38 - RNA, 89 nt, Artificial Sequence
  Synthetic Oligonucleotide
acgagguucugucuuuuggucaggacaaccgucuagcuauaagugcugcagggugugagaaacuccuauugcuggacgaugucucuuuu

SEQ ID NO: 39 - RNA, 98 nt, Artificial Sequence
  Synthetic Oligonucleotide
gagguucugucuuuggucaggacaaccgucuagcuauaagugcugcagggugugagaaacuccuauugcuggacgaugucucuacgaggcauuagcac

SEQ ID NO: 40 - RNA, 106 nt, Artificial Sequence
  Synthetic Oligonucleotide
acgagguucugucuuuuggucaggacaaccgucuagcuauaagugcugcagggugugagaaacuccuauugcuggacgaugucucuaugauacgaggcauuagcac

SEQ ID NO: 41 - RNA, 102 nt, Artificial Sequence
  Synthetic Oligonucleotide
acgagguucugucuuuuggucaggacaaccgucuagcuauaagugcugcagggugugagaaacuccuauugcuggacgaugucucuuacgaggcauuagcac

SEQ ID NO: 42 - DNA, 104 bp, Artificial Sequence
  Synthetic Oligonucleotide
gacctatagggtcaatgaatctgtgcgtgtgccataagtaattaaaaattacccaccacaggattatcttatttctgcaaaagcagaaataagatgattggcac

SEQ ID NO: 43 - DNA, 107 bp, Artificial Sequence
  Synthetic Oligonucleotide
ggtgacctatagggtcaatgaatctgtgcgtgtgccataagtaattaaaaattacccaccacaggattatcttatttctgcaaaagcagaaataagatgattggcac

SEQ ID NO: 44 - DNA, 101 bp, Artificial Sequence
  Synthetic Oligonucleotide
ctatagggtcaatgaatctgtgcgtgtgccataagtaattaaaaattacccaccacaggattatcttatttctgcaaaagcagaaataagatgattggcac

SEQ ID NO: 45 - DNA, 88 bp, Artificial Sequence
  Synthetic Oligonucleotide
gacctatagggtcaatgaatctgtgcgtgtgccataagtaattaaaaattacccaccacaggatcatcttaaaaaagatgattggcac

SEQ ID NO: 46 - DNA, 98 bp, Artificial Sequence
  Synthetic Oligonucleotide
gacctatagggtcaatgaatctgtgcgtgtgccataagtaattaaaaattacccaccacaggatcatcttatttcaaaagaaataagatgattggcac

SEQ ID NO: 47 - DNA, 88 bp, Artificial Sequence
  Synthetic Oligonucleotide
gacctatagggtcaatgaatctgtgcgtgtgccataagtaattaaaaattacccaccacaggagcacctgaaaacaggtgcttggcac

SEQ ID NO: 48 - DNA, 36 bp, Artificial Sequence
  Synthetic Oligonucleotide
gccgtttccctcactcctgctcggtgaatttggctc

SEQ ID NO: 49 - DNA, 36 bp, Artificial Sequence
  Synthetic Oligonucleotide
gagccaaattcaccgagcaggagtgagggaaacggc

SEQ ID NO: 50 - DNA, 36 bp, Artificial Sequence
  Synthetic Oligonucleotide
gccgttcccctcactcctgctcggcaaatttagctc

SEQ ID NO: 51 - DNA, 36 bp, Artificial Sequence
  Synthetic Oligonucleotide
gagctaaatttgccgagcaggagtgaggggaacggc

SEQ ID NO: 52 - DNA, 36 bp, Artificial Sequence
  Synthetic Oligonucleotide
gctgtttgggaggtcagaaatagggggtccaggagc

SEQ ID NO: 53 - DNA, 36 bp, Artificial Sequence
  Synthetic Oligonucleotide
gctcctggaccccctatttctgacctcccaaacagc

SEQ ID NO: 54 - DNA, 36 bp, Artificial Sequence
  Synthetic Oligonucleotide
gctgttagggaggtcagaaataggatgtccaagagc

SEQ ID NO: 55 - DNA, 36 bp, Artificial Sequence
  Synthetic Oligonucleotide
gctcttggacatcctatttctgacctccctaacagc

SEQ ID NO: 56 - DNA, 36 bp, Artificial Sequence
  Synthetic Oligonucleotide
ccaaattcttctcccctgggaagcatccctggacac

SEQ ID NO: 57 - DNA, 36 bp, Artificial Sequence
  Synthetic Oligonucleotide
gtgtcgaggtgtgcttcccaggggagaaggatttgg

SEQ ID NO: 58 - DNA, 36 bp, Artificial Sequence
  Synthetic Oligonucleotide
ccaaatccttctcccctgggaagcacacctcgacac

SEQ ID NO: 59 - DNA, 36 bp, Artificial Sequence
  Synthetic Oligonucleotide
ggtttaggaagaggggacccttcgtgtggagctgtg

SEQ ID NO: 60 - DNA, 36 bp, Artificial Sequence; identical to SEQ ID NO: 48
  Synthetic Oligonucleotide

SEQ ID NO: 61 - DNA, 36 bp, Artificial Sequence
  Synthetic Oligonucleotide
gagccaaattcaccgagcaagagtgagggaaacggc

SEQ ID NO: 62 - DNA, 36 bp, Artificial Sequence; identical to SEQ ID NO: 50
  Synthetic Oligonucleotide

SEQ ID NO: 63 - DNA, 36 bp, Artificial Sequence; identical to SEQ ID NO: 51
  Synthetic Oligonucleotide

SEQ ID NO: 64 - DNA, 107 bp, Artificial Sequence
  Synthetic Oligonucleotide
accatctactccatcatcttcttaactggcattgtgggcaatggattggtcatcctggtcatgggttaccagaagaaactgagaagcatgacggacaagtacaggct

SEQ ID NO: 65 - DNA, 107 bp, Artificial Sequence
  Synthetic Oligonucleotide
agcctgtacttgtccgtcatgcttctcagtttcttctggtaacccatgaccaggatgaccaatccattgcccacaatgccagttaagaagatgatggagtagatggt

SEQ ID NO: 66 - protein, 36 aa, Artificial Sequence
  Synthetic Peptide
TIYSIIFLTGIVGNGLVILVMGYQKKLRSMTDKYRL

SEQ ID NO: 67 - DNA, 107 bp, Artificial Sequence
  Synthetic Oligonucleotide
gcacctgtcagtggccgacctcctctttgtcatcacgcttcccttctgggcagttgatgccgtggcaaactggtactttgggaacttcctatgcaaggcagtccatg

SEQ ID NO: 68 - DNA, 107 bp, Artificial Sequence
  Synthetic Oligonucleotide
catggactgccttgcataggaagttcccaaagtaccagtttgccacggcatcaactgcccagaagggaagcgtgatgacaaagaggaggtcggccactgacaggtgc

SEQ ID NO: 69 - protein, 35 aa, Artificial Sequence
  Synthetic Peptide
HLSVADLLFVITLPFWAVDAVANWYFGNFLCKAVH

SEQ ID NO: 70 - DNA, 107 bp, Artificial Sequence
  Synthetic Oligonucleotide
tcatctacacagtcaacctctacagcagtgtcctcatcctggccttcatcagtctggaccgctacctggccatcgtccacgccaccaacagtcagaggccaaggaag

SEQ ID NO: 71 - DNA, 107 bp, Artificial Sequence
  Synthetic Oligonucleotide
cttccttggcctctgactgttggtggcgtggacgatggccaggtagcggtccagactgatgaaggccaggatgaggacactgctgtagaggttgactgtgtagatga

SEQ ID NO: 72 - protein, 36 aa, Artificial Sequence
  Synthetic Peptide
VIYTVNLYSSVLILAFISLDRYLAIVHATNSQRPRK

SEQ ID NO: 73 - DNA, 107 bp, Artificial Sequence
  Synthetic Oligonucleotide
ctgttggctgaaaaggtggtctatgttggcgtctggatccctgccctcctgctgactattcccgacttcatctttgccaacgtcagtgaggcagatgacagatatat

SEQ ID NO: 74 - DNA, 107 bp, Artificial Sequence
  Synthetic Oligonucleotide
atatatctgtcatctgcctcactgacgttggcaaagatgaagtcgggaatagtcagcaggagggcagggatccagacgccaacatagaccaccttttcagccaacag

SEQ ID NO: 75 - protein, 36 aa, Artificial Sequence
  Synthetic Peptide
LLAEKVVYVGVWIPALLLTIPDFIFANVSEADDRYI

SEQ ID NO: 76 - DNA, 23 bp, Artificial Sequence
  Synthetic Oligonucleotide
ccgacttcatctttgccaacgtc

SEQ ID NO: 77 - DNA, 23 bp, Artificial Sequence
  Synthetic Oligonucleotide
tgggcaatggattggtcatcctg

SEQ ID NO: 78 - RNA, 122 nt, Bacillus hisashii
  misc_feature (103)..(122): n is a, c, g, or u
acgagguucugucuuuuggucaggacaaccgucuagcuauaagugcugcagggugugagaaacuccuauugcuggacgaugucucuuacgaggcauuagcacnnnnnnnnnnnnnnnnnnnn

SEQ ID NO: 79 - DNA, 36 bp, Artificial Sequence; identical to SEQ ID NO: 48
  Synthetic Oligonucleotide

SEQ ID NO: 80 - DNA, 36 bp, Artificial Sequence; identical to SEQ ID NO: 49
  Synthetic Oligonucleotide

SEQ ID NO: 81 - DNA, 36 bp, Artificial Sequence; identical to SEQ ID NO: 50
  Synthetic Oligonucleotide

SEQ ID NO: 82 - DNA, 36 bp, Artificial Sequence; identical to SEQ ID NO: 50
  Synthetic Oligonucleotide

SEQ ID NO: 83 - DNA, 36 bp, Artificial Sequence; identical to SEQ ID NO: 51
  Synthetic Oligonucleotide

SEQ ID NO: 84 - RNA, 115 nt, Artificial Sequence
  Synthetic Oligonucleotide
gucgucuauaggacggcgaggacaacgggaagugccaaugugcucuuuccaagagcaaacaccccguuggcuucaagaugaccgcucgaaaacgagcggucugagaaguggcacu

SEQ ID NO: 85 - RNA, 113 nt, Artificial Sequence
  Synthetic Oligonucleotide
gucgucuauaggacggcgaggacaacgggaagugccaaugugcucuuuccaagagcaaacaccccguuggcuucucagaccgcucgaaaacgagcggucugagaaguggcacu

SEQ ID NO: 86 - RNA, 118 nt, Artificial Sequence
  Synthetic Oligonucleotide
acagucgucuauaggacggcgaggacaacgggaagugccaaugugcucuuuccaagagcaaacaccccguuggcuucaagaugaccgcucgaaaacgagcggucugagaaguggcacu

SEQ ID NO: 87 - RNA, 112 nt, Artificial Sequence
  Synthetic Oligonucleotide
gucuauaggacggcgaggacaacgggaagugccaaugugcucuuuccaagagcaaacaccccguuggcuucaagaugaccgcucgaaaacgagcggucugagaaguggcacu

SEQ ID NO: 88 - RNA, 111 nt, Artificial Sequence
  Synthetic Oligonucleotide
gucgucuauaggacggcgaggacaacggggugccaaugugcucuuuccaagagcaaacaccccguuggcuucucagaccgcucgaaaacgagcggucugagaaguggcacu

SEQ ID NO: 89 - RNA, 105 nt, Artificial Sequence
  Synthetic Oligonucleotide
gucgucuauaggacggcgaggacaacgggaagugccaaugugcucuuuccaagagcaaacaccccguuggcuucucagaccgaaaacggucugagaaguggcacu

SEQ ID NO: 90 - RNA, 102 nt, Artificial Sequence; identical to SEQ ID NO: 41
  Synthetic Oligonucleotide

SEQ ID NO: 91 - RNA, 97 nt, Artificial Sequence
  Synthetic Oligonucleotide
guucugucuuuuggucaggacaaccgucuagcuauaagugcugcagggugugagaaacuccuauugcuggacgaugucucuuacgaggcauuagcac

SEQ ID NO: 92 - RNA, 97 nt, Artificial Sequence
  Synthetic Oligonucleotide
guucugucuuuuggucaggacaaccgucuagcuauaagugcugcagggugugagaaacuccuauugcuggacgacgccucuuacgaggcguuagcac

SEQ ID NO: 93 - RNA, 95 nt, Artificial Sequence
  Synthetic Oligonucleotide
guucugucuuuuggucaggacaaccgucuagcuauaagugcugcagggugugagaaacuccuauugcuggacgacgccuuacgaggcguuagcac

SEQ ID NO: 94 - RNA, 92 nt, Artificial Sequence
  Synthetic Oligonucleotide
guucugucuuuuggucaggacaaccguccagcuauaagugcugcagggugcagaaacuccuauugcuggacgacgccuuacggcguuagcac

SEQ ID NO: 95 - RNA, 115 nt, Artificial Sequence
  Synthetic Oligonucleotide
guucugucuuuuggucaggacaaccguccagcuauaagugcugcagggugcagaaacuccuauugcuggacgacgccucauuuauuucaaaagaaauguuacgaggcguuagcac

SEQ ID NO: 96 - RNA, 135 nt, Artificial Sequence
  Synthetic Oligonucleotide
  misc_feature (116)..(135): n is a, c, g, or u
gucgucuauaggacggcgaggacaacgggaagugccaaugugcucuuuccaagagcaaacaccccguuggcuucaagaugaccgcucgaaaacgagcggucugagaaguggcacunnnnnnnnnnnnnnnnnnnn

SEQ ID NO: 97 - RNA, 104 nt, Artificial Sequence
  Synthetic Oligonucleotide
gaccuauagggucaaugaaucugugcgugugccauaaguaauuaaaaauuacccaccacaggauuaucuuauuucugcaaaagcagaaauaagaugauuggcac

SEQ ID NO: 98 - RNA, 107 nt, Artificial Sequence
  Synthetic Oligonucleotide
ggugaccuauagggucaaugaaucugugcgugugccauaaguaauuaaaaauuacccaacacaggauuaucuuauuucugcaaaagcagaaauaagaugauuggcac

SEQ ID NO: 99 - RNA, 101 nt, Artificial Sequence
  Synthetic Oligonucleotide
cuauagggucaaugaaucugugcgugugccauaaguaauuaaaaauuacccaccacaggauuaucuuauuucugcaaaagcagaaauaagaugauuggcac

SEQ ID NO: 100 - RNA, 88 nt, Artificial Sequence
  Synthetic Oligonucleotide
gaccuauagggucaaugaaucugugcgugugccauaaguaauuaaaaauuacccaccacaggaucaucuuaaaaaagaugauuggcac

SEQ ID NO: 101 - RNA, 98 nt, Artificial Sequence
  Synthetic Oligonucleotide
gaccuauagggucaaugaaucugugcgugugccauaaguaauuaaaaauuacccaccacaggaucaucuuauuucaaaagaaauaagaugauuggcac

SEQ ID NO: 102 - RNA, 88 nt, Artificial Sequence
  Synthetic Oligonucleotide
gaccuauagggucaaugaaucugugcgugugccauaaguaauuaaaaauuacccaccacaggagcaccugaaaacaggugcuuggcac

SEQ ID NO: 103 - RNA, 124 nt, Artificial Sequence
  Synthetic Oligonucleotide
  misc_feature (105)..(124): n is a, c, g, or u
gaccuauagggucaaaguaucugugcgugugccauaaguaauuaaaaauuacccaccacaggauuaucuuauuucugcaaaagcagaaauaagaugauuggcacnnnnnnnnnnnnnnnnnnnn

SEQ ID NO: 104 - DNA, 36 bp, Artificial Sequence; identical to SEQ ID NO: 56
  Synthetic Oligonucleotide

SEQ ID NO: 105 - DNA, 36 bp, Artificial Sequence
  Synthetic Oligonucleotide
gtgtccagggatgcttcccaggggagaagaatttgg

SEQ ID NO: 106 - DNA, 40 bp, Artificial Sequence
  Synthetic Oligonucleotide
  misc_feature (1)..(2): n is a, c, g, or t
  misc_feature (39)..(40): n is a, c, g, or t
nnccaaatccttctcccctgggaagcacacctcgacacnn

SEQ ID NO: 107 - DNA, 36 bp, Artificial Sequence; identical to SEQ ID NO: 58
  Synthetic Oligonucleotide

SEQ ID NO: 108 - DNA, 36 bp, Artificial Sequence; identical to SEQ ID NO: 57
  Synthetic Oligonucleotide

SEQ ID NO: 109 - DNA, 23 bp, Artificial Sequence
  Synthetic Oligonucleotide
  misc_feature (21)..(21): n is a, c, g, or t
agagcactggcatggggatgngg

SEQ ID NO: 110 - DNA, 23 bp, Artificial Sequence
  Synthetic Oligonucleotide
  misc_feature (21)..(21): n is a, c, g, or t
ggaacactggcatggagatgngg

SEQ ID NO: 111 - DNA, 23 bp, Artificial Sequence
  Synthetic Oligonucleotide
  misc_feature (21)..(21): n is a, c, g, or t
agaacagtggcatggggatgngg

SEQ ID NO: 112 - DNA, 23 bp, Artificial Sequence
  Synthetic Oligonucleotide
  misc_feature (21)..(21): n is a, c, g, or t
tgaacactggcatggggaagngg

SEQ ID NO: 113 - DNA, 23 bp, Artificial Sequence
  Synthetic Oligonucleotide
  misc_feature (21)..(21): n is a, c, g, or t
gaagcactgccatgggaatgngg

SEQ ID NO: 114 - DNA, 23 bp, Artificial Sequence
  Synthetic Oligonucleotide
  misc_feature (21)..(21): n is a, c, g, or t
agagcactggaatgggaatgngg

SEQ ID NO: 115 - DNA, 23 bp, Artificial Sequence
  Synthetic Oligonucleotide
  misc_feature (21)..(21): n is a, c, g, or t
ggagcgctggcatggggactngg

SEQ ID NO: 116 - DNA, 23 bp, Artificial Sequence
  Synthetic Oligonucleotide
  misc_feature (21)..(21): n is a, c, g, or t
tgaacactggcatggggctgngg

SEQ ID NO: 117 - DNA, 23 bp, Artificial Sequence
  Synthetic Oligonucleotide
  misc_feature (21)..(21): n is a, c, g, or t
agagcactggcaggaggatgngg

SEQ ID NO: 118 - DNA, 23 bp, Artificial Sequence
  Synthetic Oligonucleotide
  misc_feature (21)..(21): n is a, c, g, or t
ggagcactggcatgggatgtnga

SEQ ID NO: 119 - DNA, 23 bp, Artificial Sequence
  Synthetic Oligonucleotide
  misc_feature (21)..(21): n is a, c, g, or t
gagcccctggcatggggatgngg

SEQ ID NO: 120 - DNA, 23 bp, Artificial Sequence
  Synthetic Oligonucleotide
  misc_feature (21)..(21): n is a, c, g, or t
caggcactggcatggggaccngg

SEQ ID NO: 121 - DNA, 23 bp, Artificial Sequence
  Synthetic Oligonucleotide
  misc_feature (21)..(21): n is a, c, g, or t
aggatacaggcaggggaatgngg

SEQ ID NO: 122 - DNA, 23 bp, Artificial Sequence
  Synthetic Oligonucleotide
  misc_feature (21)..(21): n is a, c, g, or t
agaatactggcatgggaatgngg

SEQ ID NO: 123 - DNA, 23 bp, Artificial Sequence
  Synthetic Oligonucleotide
  misc_feature (21)..(21): n is a, c, g, or t
gaaggactggcacggggatgngg

SEQ ID NO: 124 - DNA, 23 bp, Artificial Sequence
  Synthetic Oligonucleotide
  misc_feature (21)..(21): n is a, c, g, or t
ggagcactggtagggggatgngg

SEQ ID NO: 125 - DNA, 23 bp, Artificial Sequence
  Synthetic Oligonucleotide
  misc_feature (21)..(21): n is a, c, g, or t
agagaactgccatgggaatgngg

SEQ ID NO: 126 - DNA, 23 bp, Artificial Sequence
  Synthetic Oligonucleotide
  misc_feature (21)..(21): n is a, c, g, or t
aaagcactggccatgggatgngg

SEQ ID NO: 127 - DNA, 23 bp, Artificial Sequence
  Synthetic Oligonucleotide
  misc_feature (21)..(21): n is a, c, g, or t
gaggcactggcatgggggtgngg

SEQ ID NO: 128 - DNA, 23 bp, Artificial Sequence
  Synthetic Oligonucleotide
  misc_feature (21)..(21): n is a, c, g, or t
agagcacgggcatgaggatcngg

SEQ ID NO: 129 - DNA, 27 bp, Artificial Sequence
  Synthetic Oligonucleotide
  misc_feature (4)..(4): n is a, c, g, or t
attntagagcactggcatggggatggg

SEQ ID NO: 130 - DNA, 27 bp, Artificial Sequence
  Synthetic Oligonucleotide
  misc_feature (4)..(4): n is a, c, g, or t
attntagagcactggcatggggatggg

SEQ ID NO: 131 - DNA, 23 bp, Artificial Sequence
  Synthetic Oligonucleotide
  misc_feature (21)..(21): n is a, c, g, or t
tgctccagaggccccccttgngg

SEQ ID NO: 132 - DNA, 23 bp, Artificial Sequence
  Synthetic Oligonucleotide
  misc_feature (21)..(21): n is a, c, g, or t
ggctccagaggctccccttgnga

SEQ ID NO: 133 - DNA, 23 bp, Artificial Sequence
  Synthetic Oligonucleotide
  misc_feature (21)..(21): n is a, c, g, or t
tgctccagaggctccccttgngg

SEQ ID NO: 134 - DNA, 23 bp, Artificial Sequence
  Synthetic Oligonucleotide
  misc_feature (21)..(21): n is a, c, g, or t
ggctccagaggcccccctgcngg

SEQ ID NO: 135 - DNA, 23 bp, Artificial Sequence
  Synthetic Oligonucleotide
  misc_feature (21)..(21): n is a, c, g, or t
agctccagagcccccccttgnga

SEQ ID NO: 136 - DNA, 23 bp, Artificial Sequence
  Synthetic Oligonucleotide
  misc_feature (21)..(21): n is a, c, g, or t
tgccccagaggcccccctcangg

SEQ ID NO: 137 - DNA, 23 bp, Artificial Sequence
  Synthetic Oligonucleotide
  misc_feature (21)..(21): n is a, c, g, or t
ggctccagaggctcccctgtngg

SEQ ID NO: 138 - DNA, 23 bp, Artificial Sequence
  Synthetic Oligonucleotide
  misc_feature (21)..(21): n is a, c, g, or t
tgctccagggacccccctctngg

SEQ ID NO: 139 - DNA, 23 bp, Artificial Sequence
  Synthetic Oligonucleotide
  misc_feature (21)..(21): n is a, c, g, or t
agctccagacactccccttgngg

SEQ ID NO: 140 - DNA, 23 bp, Artificial Sequence
  Synthetic Oligonucleotide
  misc_feature (21)..(21): n is a, c, g, or t
gtctccagaggctcccctgangg

SEQ ID NO: 141 - DNA, 23 bp, Artificial Sequence
  Synthetic Oligonucleotide
  misc_feature (21)..(21): n is a, c, g, or t
ggctccaaaaacccccctttngg

SEQ ID NO: 142 - DNA, 23 bp, Artificial Sequence
  Synthetic Oligonucleotide
  misc_feature (21)..(21): n is a, c, g, or t
tgctccaagggccccccttgnag

SEQ ID NO: 143 - DNA, 23 bp, Artificial Sequence
  Synthetic Oligonucleotide
  misc_feature (21)..(21): n is a, c, g, or t
aggtccagaggccacccttgngg

SEQ ID NO: 144 - DNA, 23 bp, Artificial Sequence
  Synthetic Oligonucleotide
  misc_feature (21)..(21): n is a, c, g, or t
atctccagaggcctccctggngg

SEQ ID NO: 145 - DNA, 23 bp, Artificial Sequence
  Synthetic Oligonucleotide
  misc_feature (21)..(21): n is a, c, g, or t
cctgccccagaggtcccttgngg

SEQ ID NO: 146 - DNA, 23 bp, Artificial Sequence
  Synthetic Oligonucleotide
  misc_feature (21)..(21): n is a, c, g, or t
tgctccagagctccccttctnga

SEQ ID NO: 147 - DNA, 23 bp, Artificial Sequence
  Synthetic Oligonucleotide
  misc_feature (21)..(21): n is a, c, g, or t
ctatccagaggctcccctccngg

SEQ ID NO: 148 - DNA, 23 bp, Artificial Sequence
  Synthetic Oligonucleotide
  misc_feature (21)..(21): n is a, c, g, or t
ctcctcagaggcccccctggngg

SEQ ID NO: 149 - DNA, 23 bp, Artificial Sequence
  Synthetic Oligonucleotide
  misc_feature (21)..(21): n is a, c, g, or t
ggctccaggggccccacttgngg

SEQ ID NO: 150 - DNA, 23 bp, Artificial Sequence
  Synthetic Oligonucleotide
  misc_feature (21)..(21): n is a, c, g, or t
ttttccagaggcccccctccngg

SEQ ID NO: 151 - DNA, 27 bp, Artificial Sequence
  Synthetic Oligonucleotide
  misc_feature (4)..(4): n is a, c, g, or t
attnttgctccagaggccccccttggg

SEQ ID NO: 152 - DNA, 27 bp, Artificial Sequence
  Synthetic Oligonucleotide
  misc_feature (4)..(4): n is a, c, g, or t
attnttgctccagaggccccccttggg

SEQ ID NO: 153 - DNA, 23 bp, Artificial Sequence
  Synthetic Oligonucleotide
  misc_feature (21)..(21): n is a, c, g, or t
ggtgccagaaacaggggtgangg

SEQ ID NO: 154 - DNA, 23 bp, Artificial Sequence
  Synthetic Oligonucleotide
  misc_feature (21)..(21): n is a, c, g, or t
ggtaccagaaacaggggggangg

SEQ ID NO: 155 - DNA, 23 bp, Artificial Sequence
  Synthetic Oligonucleotide
gctgccaggaacagaggtgaggg

SEQ ID NO: 156 - DNA, 23 bp, Artificial Sequence
  Synthetic Oligonucleotide
  misc_feature (21)..(21): n is a, c, g, or t
ggttccagaaagaggggtgangg

SEQ ID NO: 157 - DNA, 23 bp, Artificial Sequence
  Synthetic Oligonucleotide
  misc_feature (21)..(21): n is a, c, g, or t
aatgccaggaacaggggtggngg

SEQ ID NO: 158 - DNA, 22 bp, Artificial Sequence
  Synthetic Oligonucleotide
  misc_feature (20)..(20): n is a, c, g, or t
gggccagaaacaggggtgangg

SEQ ID NO: 159 - DNA, 23 bp, Artificial Sequence
  Synthetic Oligonucleotide
  misc_feature (21)..(21): n is a, c, g, or t
caagccagaaacaggggtgangg

SEQ ID NO: 160 - DNA, 23 bp, Artificial Sequence
  Synthetic Oligonucleotide
  misc_feature (21)..(21): n is a, c, g, or t
ggtatcagaagcaggggtgangg

SEQ ID NO: 161 - DNA, 23 bp, Artificial Sequence
  Synthetic Oligonucleotide
  misc_feature (21)..(21): n is a, c, g, or t
gaggccagaaaaaggggtgangg

SEQ ID NO: 162 - DNA, 23 bp, Artificial Sequence
  Synthetic Oligonucleotide
  misc_feature (21)..(21): n is a, c, g, or t
ggtggcaggaacaggggtggngg

SEQ ID NO: 163 - DNA, 23 bp, Artificial Sequence
  Synthetic Oligonucleotide
  misc_feature (21)..(21): n is a, c, g, or t
agtgacagaaacaggaatgangg

SEQ ID NO: 164 - DNA, 23 bp, Artificial Sequence
  Synthetic Oligonucleotide
  misc_feature (21)..(21): n is a, c, g, or t
gaagccagaagcaggggtgangg

SEQ ID NO: 165 - DNA, 23 bp, Artificial Sequence
  Synthetic Oligonucleotide
  misc_feature (21)..(21): n is a, c, g, or t
ggagccagaagcaggggagangg

SEQ ID NO: 166 - DNA, 23 bp, Artificial Sequence
  Synthetic Oligonucleotide
  misc_feature (21)..(21): n is a, c, g, or t
ggagccagaaacagggatggngg

SEQ ID NO: 167 - DNA, 23 bp, Artificial Sequence
  Synthetic Oligonucleotide
  misc_feature (21)..(21): n is a, c, g, or t
agtaccaggaacaggggagtngg

SEQ ID NO: 168 - DNA, 23 bp, Artificial Sequence
  Synthetic Oligonucleotide
  misc_feature (21)..(21): n is a, c, g, or t
agtgccaggagcaggggagangg

SEQ ID NO: 169 - DNA, 23 bp, Artificial Sequence
  Synthetic Oligonucleotide
  misc_feature (21)..(21): n is a, c, g, or t
ggtaccaaaaaaaggggagangg

SEQ ID NO: 170 - DNA, 23 bp, Artificial Sequence
  Synthetic Oligonucleotide
  misc_feature (21)..(21): n is a, c, g, or t
gatgccagaggcaggggagangg

SEQ ID NO: 171 - DNA, 23 bp, Artificial Sequence
  Synthetic Oligonucleotide
  misc_feature (21)..(21): n is a, c, g, or t
agggccagaaacaggagggangg

SEQ ID NO: 172 - DNA, 23 bp, Artificial Sequence
  Synthetic Oligonucleotide
  misc_feature (21)..(21): n is a, c, g, or t
ggtgccaggaacgggggtgangg

SEQ ID NO: 173 - DNA, 27 bp, Artificial Sequence
  Synthetic Oligonucleotide
  misc_feature (4)..(4): n is a, c, g, or t
attnctggtgccagaaacaggggtgac

SEQ ID NO: 174 - DNA, 27 bp, Artificial Sequence
  Synthetic Oligonucleotide
  misc_feature (4)..(4): n is a, c, g, or t
attnctggtgccagaaacaggggtgac

SEQ ID NO: 175 - DNA, 23 bp, Artificial Sequence
  Synthetic Oligonucleotide
gggcttcaagcaacttgtagcgg

SEQ ID NO: 176 - DNA, 27 bp, Artificial Sequence
  Synthetic Oligonucleotide
  misc_feature (4)..(4): n is a, c, g, or t
attntgggcttcaagcaacttgtagtg

SEQ ID NO: 177 - DNA, 27 bp, Artificial Sequence
  Synthetic Oligonucleotide
  misc_feature (4)..(4): n is a, c, g, or t
attntgggcttcaagcaacttgtagtg

SEQ ID NO: 178 - DNA, 23 bp, Artificial Sequence
  Synthetic Oligonucleotide
  misc_feature (21)..(21): n is a, c, g, or t
gtaattggttctaccaaagangg

SEQ ID NO: 179 - DNA, 23 bp, Artificial Sequence
  Synthetic Oligonucleotide
  misc_feature (21)..(21): n is a, c, g, or t
ttaattggttctaccaaagangg

SEQ ID NO: 180 - DNA, 27 bp, Artificial Sequence
  Synthetic Oligonucleotide
  misc_feature (4)..(4): n is a, c, g, or t
attntgtaattggttctaccaaagaag

SEQ ID NO: 181 - DNA, 27 bp, Artificial Sequence
  Synthetic Oligonucleotide
  misc_feature (4)..(4): n is a, c, g, or t
attntgtaattggttctaccaaagaag

SEQ ID NO: 182 - DNA, 23 bp, Artificial Sequence
  Synthetic Oligonucleotide
  misc_feature (21)..(21): n is a, c, g, or t
gaggcggagggcggcgtgccngg

SEQ ID NO: 183 - DNA, 23 bp, Artificial Sequence
  Synthetic Oligonucleotide
  misc_feature (21)..(21): n is a, c, g, or t
aaggccgagggcagcatgccngg

SEQ ID NO: 184 - DNA, 23 bp, Artificial Sequence
  Synthetic Oligonucleotide
  misc_feature (21)..(21): n is a, c, g, or t
tgggcggagggaggcgcaccngg

SEQ ID NO: 185 - DNA, 27 bp, Artificial Sequence
  Synthetic Oligonucleotide
  misc_feature (4)..(4): n is a, c, g, or t
attnagaggcggagggcggcgtgcctg

SEQ ID NO: 186 - DNA, 27 bp, Artificial Sequence
  Synthetic Oligonucleotide
  misc_feature (4)..(4): n is a, c, g, or t
attnagaggcggagggcggcgtgcctg

SEQ ID NO: 187 - DNA, 23 bp, Artificial Sequence
  Synthetic Oligonucleotide
  misc_feature (21)..(21): n is a, c, g, or t
agtgtccagggatgcttcccngg

SEQ ID NO: 188 - DNA, 23 bp, Artificial Sequence
  Synthetic Oligonucleotide
  misc_feature (21)..(21): n is a, c, g, or t
catccccagggaagcatcccngg

SEQ ID NO: 189 - DNA, 23 bp, Artificial Sequence
  Synthetic Oligonucleotide
  misc_feature (21)..(21): n is a, c, g, or t
agtggctagggatgcttcccngg

SEQ ID NO: 190 - DNA, 23 bp, Artificial Sequence
  Synthetic Oligonucleotide
  misc_feature (21)..(21): n is a, c, g, or t
atagtccagggatgcttcctngg

SEQ ID NO: 191 - DNA, 23 bp, Artificial Sequence
  Synthetic Oligonucleotide
  misc_feature (21)..(21): n is a, c, g, or t
cgtgaccagggatgcttctcngg

SEQ ID NO: 192 - DNA, 23 bp, Artificial Sequence
  Synthetic Oligonucleotide
  misc_feature (21)..(21): n is a, c, g, or t
gctccccggggaagcttcccnga

SEQ ID NO: 193 - DNA, 23 bp, Artificial Sequence
  Synthetic Oligonucleotide
  misc_feature (21)..(21): n is a, c, g, or t
catgtccagaaatgcttcccngg

SEQ ID NO: 194 - DNA, 23 bp, Artificial Sequence
  Synthetic Oligonucleotide
  misc_feature (21)..(21): n is a, c, g, or t
agtgtccagggatgcttcccnag

SEQ ID NO: 195 - DNA, 23 bp, Artificial Sequence
  Synthetic Oligonucleotide
  misc_feature (21)..(21): n is a, c, g, or t
tcggtccagggatgcttcccntg

SEQ ID NO: 196 - DNA, 23 bp, Artificial Sequence
  Synthetic Oligonucleotide
  misc_feature (21)..(21): n is a, c, g, or t
caagtccatggatgcttcccngg

SEQ ID NO: 197 - DNA, 23 bp, Artificial Sequence
  Synthetic Oligonucleotide
  misc_feature (21)..(21): n is a, c, g, or t
ccagtccaggaaagcatcccngg

SEQ ID NO: 198 - DNA, 23 bp, Artificial Sequence
  Synthetic Oligonucleotide
  misc_feature (21)..(21): n is a, c, g, or t
cctggcctggggagcatcccnga

SEQ ID NO: 199 - DNA, 23 bp, Artificial Sequence
  Synthetic Oligonucleotide
  misc_feature (21)..(21): n is a, c, g, or t
tgtgtgcagggatgcttcctngg

SEQ ID NO: 200 - DNA, 23 bp, Artificial Sequence
  Synthetic Oligonucleotide
  misc_feature (21)..(21): n is a, c, g, or t
agactccagggaagcttcccngg

SEQ ID NO: 201 - DNA, 23 bp, Artificial Sequence
  Synthetic Oligonucleotide
  misc_feature (21)..(21): n is a, c, g, or t
agggtccaggcacgcttcccngg

SEQ ID NO: 202 - DNA, 23 bp, Artificial Sequence
  Synthetic Oligonucleotide
  misc_feature (21)..(21): n is a, c, g, or t
tgtttccaggaatgcttcccngg

SEQ ID NO: 203 - DNA, 23 bp, Artificial Sequence
  Synthetic Oligonucleotide
  misc_feature (21)..(21): n is a, c, g, or t
agagtccaggaatgcttcccnga

SEQ ID NO: 204 - DNA, 23 bp, Artificial Sequence
  Synthetic Oligonucleotide
  misc_feature (21)..(21): n is a, c, g, or t
atgtcacagggattcttcccngg

SEQ ID NO: 205 - DNA, 23 bp, Artificial Sequence
  Synthetic Oligonucleotide
  misc_feature (21)..(21): n is a, c, g, or t
caagtccagagatgcttcctngg

SEQ ID NO: 206 - DNA, 23 bp, Artificial Sequence
  Synthetic Oligonucleotide
  misc_feature (21)..(21): n is a, c, g, or t
agtgtccagggaagcttcgcngg

SEQ ID NO: 207 - DNA, 27 bp, Artificial Sequence
  Synthetic Oligonucleotide
  misc_feature (4)..(4): n is a, c, g, or t
tttnggaagtgtccagggatgcttccc

SEQ ID NO: 208 - DNA, 27 bp, Artificial Sequence
  Synthetic Oligonucleotide
  misc_feature (4)..(4): n is a, c, g, or t
tttnggaagtgtccagggatgcttccc

SEQ ID NO: 209 - DNA, 27 bp, Artificial Sequence
  Synthetic Oligonucleotide
  misc_feature (4)..(4): n is a, c, g, or t
tttnggaagtgtccagggatgcttccc

SEQ ID NO: 210 - DNA, 23 bp, Artificial Sequence
  Synthetic Oligonucleotide
  misc_feature (21)..(21): n is a, c, g, or t
ttcagcccaagaacagtacangg

SEQ ID NO: 211 - DNA, 23 bp, Artificial Sequence
  Synthetic Oligonucleotide
  misc_feature (21)..(21): n is a, c, g, or t
aacagtccaagaacagtacangg

SEQ ID NO: 212 - DNA, 23 bp, Artificial Sequence
  Synthetic Oligonucleotide
  misc_feature (21)..(21): n is a, c, g, or t
tatagctcaagaacagtacangg

SEQ ID NO: 213 - DNA, 27 bp, Artificial Sequence
  Synthetic Oligonucleotide
  misc_feature (4)..(4): n is a, c, g, or t
tttncttcagcccaagaacagtacaag

SEQ ID NO: 214 - DNA, 27 bp, Artificial Sequence
  Synthetic Oligonucleotide
  misc_feature (4)..(4): n is a, c, g, or t
tttncttcagcccaagaacagtacaag

SEQ ID NO: 215 - DNA, 27 bp, Artificial Sequence
  Synthetic Oligonucleotide
  misc_feature (4)..(4): n is a, c, g, or t
tttncttcagcccaagaacagtacaag

SEQ ID NO: 216 - DNA, 23 bp, Artificial Sequence
  Synthetic Oligonucleotide
  misc_feature (21)..(21): n is a, c, g, or t
gtgagtcgaggagaaacgacngg

SEQ ID NO: 217 - DNA, 23 bp, Artificial Sequence
  Synthetic Oligonucleotide
  misc_feature (21)..(21): n is a, c, g, or t
atgagccaaggagagacgaangg

SEQ ID NO: 218 - DNA, 23 bp, Artificial Sequence
  Synthetic Oligonucleotide
  misc_feature (21)..(21): n is a, c, g, or t
atgagtagaggagaaaagacngg

SEQ ID NO: 219 - DNA, 27 bp, Artificial Sequence
  Synthetic Oligonucleotide
  misc_feature (4)..(4): n is a, c, g, or t
tttntctgtgagtcgaggagaaacgac

SEQ ID NO: 220 - DNA, 27 bp, Artificial Sequence
  Synthetic Oligonucleotide
  misc_feature (4)..(4): n is a, c, g, or t
tttntctgtgagtcgaggagaaacgac

SEQ ID NO: 221 - DNA, 27 bp, Artificial Sequence
  Synthetic Oligonucleotide
  misc_feature (4)..(4): n is a, c, g, or t
tttntctgtgagtcgaggagaaacgac

SEQ ID NO: 222 - DNA, 23 bp, Artificial Sequence
  Synthetic Oligonucleotide
  misc_feature (21)..(21): n is a, c, g, or t
gggtgtgttaaaagtgaccangg

SEQ ID NO: 223 - DNA, 27 bp, Artificial Sequence
  Synthetic Oligonucleotide
  misc_feature (4)..(4): n is a, c, g, or t
tttncttgggtgtgttaaaagtgacca

SEQ ID NO: 224 - DNA, 27 bp, Artificial Sequence
  Synthetic Oligonucleotide
  misc_feature (4)..(4): n is a, c, g, or t
tttncttgggtgtgttaaaagtgacca

SEQ ID NO: 225 - DNA, 27 bp, Artificial Sequence
  Synthetic Oligonucleotide
  misc_feature (4)..(4): n is a, c, g, or t
tttncttgggtgtgttaaaagtgacca

SEQ ID NO: 226 - DNA, 23 bp, Artificial Sequence
  Synthetic Oligonucleotide
  misc_feature (21)..(21): n is a, c, g, or t
tcactcctgctcggtgaattngg

SEQ ID NO: 227 - DNA, 23 bp, Artificial Sequence
  Synthetic Oligonucleotide
gctacaggcagagacaaaggcgg

SEQ ID NO: 228 - DNA, 23 bp, Artificial Sequence
  Synthetic Oligonucleotide
aggacaggcagagacaaaggcgg

SEQ ID NO: 229 - DNA, 23 bp, Artificial Sequence
  Synthetic Oligonucleotide
agaacaggcagagacaaagacgg

SEQ ID NO: 230 - DNA, 23 bp, Artificial Sequence
  Synthetic Oligonucleotide
aagacaggcagagacaaagtcgg

SEQ ID NO: 231 - DNA, 23 bp, Artificial Sequence
  Synthetic Oligonucleotide
gctagaggtagagacaaaggcgg

SEQ ID NO: 232 - DNA, 23 bp, Artificial Sequence
  Synthetic Oligonucleotide
agaacaggcagagacaaaggcag

SEQ ID NO: 233 - DNA, 23 bp, Artificial Sequence
  Synthetic Oligonucleotide
aggacaggcagagacaaaggcgg

SEQ ID NO: 234 - DNA, 23 bp, Artificial Sequence
  Synthetic Oligonucleotide
aggacaggcagagacaaagtcgg

SEQ ID NO: 235 - DNA, 23 bp, Artificial Sequence
  Synthetic Oligonucleotide
cggacaggcagagacaaaggcgg

SEQ ID NO: 236 - DNA, 23 bp, Artificial Sequence
  Synthetic Oligonucleotide
acaacagccagagacaaaggcgg

SEQ ID NO: 237 - DNA, 23 bp, Artificial Sequence
  Synthetic Oligonucleotide
agaacaggcagagacaaagtcgg

SEQ ID NO: 238 - DNA, 23 bp, Artificial Sequence
  Synthetic Oligonucleotide
cctagaggcagagacaaagtcgg

SEQ ID NO: 239 - DNA, 23 bp, Artificial Sequence
  Synthetic Oligonucleotide
gctacagacagagacaaaggcag

SEQ ID NO: 240 - DNA, 23 bp, Artificial Sequence
  Synthetic Oligonucleotide
gctacaggcagagacaaaggcgg

SEQ ID NO: 241 - DNA, 23 bp, Artificial Sequence
  Synthetic Oligonucleotide
actacaaacagagacaaagacgg

SEQ ID NO: 242 - DNA, 23 bp, Artificial Sequence
  Synthetic Oligonucleotide
tctacagtcagagacaaaggcga

SEQ ID NO: 243 - DNA, 23 bp, Artificial Sequence
  Synthetic Oligonucleotide
aagataggcagagacaaaggcgg

SEQ ID NO: 244 - DNA, 23 bp, Artificial Sequence
  Synthetic Oligonucleotide
cctataggcagagacaaagccgg

SEQ ID NO: 245 - DNA, 23 bp, Artificial Sequence
  Synthetic Oligonucleotide
aagacaggcagagacaaagtcgg

SEQ ID NO: 246 - DNA, 23 bp, Artificial Sequence
  Synthetic Oligonucleotide
aggacaggcagagacaaaggcag

SEQ ID NO: 247 - DNA, 23 bp, Artificial Sequence
  Synthetic Oligonucleotide
  misc_feature (21)..(21): n is a, c, g, or t
aggtcagaaatagggggtccngg

SEQ ID NO: 248 - DNA, 23 bp, Artificial Sequence
  Synthetic Oligonucleotide
  misc_feature (21)..(21): n is a, c, g, or t
agggcacaaataggaggtccngg

SEQ ID NO: 249 - DNA, 23 bp, Artificial Sequence
  Synthetic Oligonucleotide
caggctgtgaaccttggtggcgg

SEQ ID NO: 250 - DNA, 23 bp, Artificial Sequence
  Synthetic Oligonucleotide
ctggctgtgaactttggtggcgg

SEQ ID NO: 251 - DNA, 23 bp, Artificial Sequence
  Synthetic Oligonucleotide
aggactgtagaccttggtggcgg

SEQ ID NO: 252 - DNA, 23 bp, Artificial Sequence
  Synthetic Oligonucleotide
atagctgtgaacctaggtggcgg

SEQ ID NO: 253 - DNA, 23 bp, Artificial Sequence
  Synthetic Oligonucleotide
caggctgtgaaccttggtgacgg

SEQ ID NO: 254 - DNA, 23 bp, Artificial Sequence
  Synthetic Oligonucleotide
cctgctatgaaccttggtgtcgg

SEQ ID NO: 255 - DNA, 23 bp, Artificial Sequence
  Synthetic Oligonucleotide
ggggctgcggaccttggtggcgg

SEQ ID NO: 256 - DNA, 23 bp, Artificial Sequence
  Synthetic Oligonucleotide
aaagctgagaaccttggtggcgg

SEQ ID NO: 257 - DNA, 23 bp, Artificial Sequence
  Synthetic Oligonucleotide
cttgctgggaaccttggtggcgg

SEQ ID NO: 258 - DNA, 23 bp, Artificial Sequence
  Synthetic Oligonucleotide
caggctgagacccttggtggcgg

SEQ ID NO: 259 - DNA, 23 bp, Artificial Sequence
  Synthetic Oligonucleotide
caggctgtgcactttggtggcgg

SEQ ID NO: 260 - DNA, 23 bp, Artificial Sequence
  Synthetic Oligonucleotide
attgctgcaaaccttggtgtcgg

SEQ ID NO: 261 - DNA, 23 bp, Artificial Sequence
  Synthetic Oligonucleotide
taggctgtaaaacttggtggcgg

SEQ ID NO: 262 - DNA, 23 bp, Artificial Sequence
  Synthetic Oligonucleotide
aaagctgggaaccttggtggcgg

SEQ ID NO: 263 - DNA, 23 bp, Artificial Sequence
  Synthetic Oligonucleotide
aggcctgagaaccttggtggcag

SEQ ID NO: 264 - DNA, 23 bp, Artificial Sequence
  Synthetic Oligonucleotide
caggctttgaactttggtagcgg

SEQ ID NO: 265 - DNA, 23 bp, Artificial Sequence
  Synthetic Oligonucleotide
caggctgttacccttggtggcgg

SEQ ID NO: 266 - DNA, 23 bp, Artificial Sequence
  Synthetic Oligonucleotide
gcagcctgtagccttggtggcgg

SEQ ID NO: 267 - DNA, 23 bp, Artificial Sequence
  Synthetic Oligonucleotide
agggatgtgaaccttggtagcag

SEQ ID NO: 268 - DNA, 23 bp, Artificial Sequence
  Synthetic Oligonucleotide
cctgctgcaaaccttggtgtcgg

SEQ ID NO: 269 - DNA, 23 bp, Artificial Sequence
  Synthetic Oligonucleotide
  misc_feature (21)..(21): n is a, c, g, or t
gaccccctccaccccgcctcngg

SEQ ID NO: 270 - DNA, 23 bp, Artificial Sequence
  Synthetic Oligonucleotide
  misc_feature (21)..(21): n is a, c, g, or t
ctgcccccccaccccgccacngg

SEQ ID NO: 271 - DNA, 23 bp, Artificial Sequence
  Synthetic Oligonucleotide
  misc_feature (21)..(21): n is a, c, g, or t
gcccccacccaccccgcctcngg

SEQ ID NO: 272 - DNA, 23 bp, Artificial Sequence
  Synthetic Oligonucleotide
  misc_feature (21)..(21): n is a, c, g, or t
gcttccctccaccccgcatcngg

SEQ ID NO: 273 - DNA, 23 bp, Artificial Sequence
  Synthetic Oligonucleotide
  misc_feature (21)..(21): n is a, c, g, or t
tgcccctcccaccccgcctcngg

SEQ ID NO: 274 - DNA, 23 bp, Artificial Sequence
  Synthetic Oligonucleotide
  misc_feature (21)..(21): n is a, c, g, or t
ctacccctccaccccgcctcngg

SEQ ID NO: 275 - DNA, 23 bp, Artificial Sequence
  Synthetic Oligonucleotide
  misc_feature (21)..(21): n is a, c, g, or t
gggcccctccaccccgcctcngg

SEQ ID NO: 276 - DNA, 23 bp, Artificial Sequence
  Synthetic Oligonucleotide
  misc_feature (21)..(21): n is a, c, g, or t
attcccccccaccccgcctcngg

SEQ ID NO: 277 - DNA, 23 bp, Artificial Sequence
  Synthetic Oligonucleotide
  misc_feature (21)..(21): n is a, c, g, or t
gaccccccccaccccgccccngg

SEQ ID NO: 278 - DNA, 23 bp, Artificial Sequence
  Synthetic Oligonucleotide
  misc_feature (21)..(21): n is a, c, g, or t
acacccccccaccccgcctcngg

SEQ ID NO: 279 - DNA, 23 bp, Artificial Sequence
  Synthetic Oligonucleotide
  misc_feature (21)..(21): n is a, c, g, or t
gccccccaccaccccacctcngg

SEQ ID NO: 280 - DNA, 23 bp, Artificial Sequence
  Synthetic Oligonucleotide
  misc_feature (21)..(21): n is a, c, g, or t
ctccccacccaccccgcctcngg

SEQ ID NO: 281 - DNA, 23 bp, Artificial Sequence
  Synthetic Oligonucleotide
  misc_feature (21)..(21): n is a, c, g, or t
tgccccccccaccccacctcngg

SEQ ID NO: 282 - DNA, 23 bp, Artificial Sequence
  Synthetic Oligonucleotide
  misc_feature (21)..(21): n is a, c, g, or t
taccccccacaccccgcctcngg

SEQ ID NO: 283 - DNA, 23 bp, Artificial Sequence
  Synthetic Oligonucleotide
  misc_feature (21)..(21): n is a, c, g, or t
gtaccccaccaccccgccccngg

SEQ ID NO: 284 - DNA, 23 bp, Artificial Sequence
  Synthetic Oligonucleotide
  misc_feature (21)..(21): n is a, c, g, or t
gacaccttccaccccgtctcngg

SEQ ID NO: 285 - DNA, 23 bp, Artificial Sequence
  Synthetic Oligonucleotide
  misc_feature (21)..(21): n is a, c, g, or t
cctcccccacaccccgcatcngg

SEQ ID NO: 286 - DNA, 23 bp, Artificial Sequence
  Synthetic Oligonucleotide
  misc_feature (21)..(21): n is a, c, g, or t
gacccctcacaccccgccccngg

SEQ ID NO: 287 - DNA, 23 bp, Artificial Sequence
  Synthetic Oligonucleotide
  misc_feature (21)..(21): n is a, c, g, or t
tccaccccccaccccgccccngg

SEQ ID NO: 288 - DNA, 23 bp, Artificial Sequence
  Synthetic Oligonucleotide
  misc_feature (21)..(21): n is a, c, g, or t
atccccctccaccccaccccngg

SEQ ID NO: 289 - DNA, 23 bp, Artificial Sequence
  Synthetic Oligonucleotide
  misc_feature (21)..(21): n is a, c, g, or t
tatctagcctcttctaagacngg

SEQ ID NO: 290 - DNA, 23 bp, Artificial Sequence
  Synthetic Oligonucleotide
  misc_feature (21)..(21): n is a, c, g, or t
tatctagcctcttctaaaacngg

SEQ ID NO: 291 - DNA, 27 bp, Artificial Sequence
  Synthetic Oligonucleotide
  misc_feature (4)..(4): n is a, c, g, or t
tttncctcactcctgctcggtgaattt

SEQ ID NO: 292 - DNA, 27 bp, Artificial Sequence
  Synthetic Oligonucleotide
  misc_feature (4)..(4): n is a, c, g, or t
tttnggaggtcagaaatagggggtcca

SEQ ID NO: 293 - DNA, 27 bp, Artificial Sequence
  Synthetic Oligonucleotide
  misc_feature (4)..(4): n is a, c, g, or t
tttngcaggtcagaaatagggagaggc

SEQ ID NO: 294 - DNA, 27 bp, Artificial Sequence
  Synthetic Oligonucleotide
  misc_feature (4)..(4): n is a, c, g, or t
tttngatggcgacttcaggcacaggat

SEQ ID NO: 295 - DNA, 27 bp, Artificial Sequence
  Synthetic Oligonucleotide
  misc_feature (4)..(4): n is a, c, g, or t
tttncttgggtgtgttaaaagtgacca

SEQ ID NO: 296 - DNA, 23 bp, Artificial Sequence
  Synthetic Oligonucleotide
  misc_feature (21)..(21): n is a, c, g, or t
tctcccctgggaagcatcccngg

SEQ ID NO: 297 - DNA, 23 bp, Artificial Sequence
  Synthetic Oligonucleotide
  misc_feature (21)..(21): n is a, c, g, or t
catccccagggaagcatcccngg

SEQ ID NO: 298 - DNA, 23 bp, Artificial Sequence
  Synthetic Oligonucleotide
  misc_feature (21)..(21): n is a, c, g, or t
gatcccctgtgaagcatcccngg

SEQ ID NO: 299 - DNA, 23 bp, Artificial Sequence
  Synthetic Oligonucleotide
  misc_feature (21)..(21): n is a, c, g, or t
tctccccggggaaacatcccngg

SEQ ID NO: 300 - DNA, 23 bp, Artificial Sequence
  Synthetic Oligonucleotide
  misc_feature (21)..(21): n is a, c, g, or t
tctcccccaggaaccatcccngg

SEQ ID NO: 301 - DNA, 23 bp, Artificial Sequence
  Synthetic Oligonucleotide
  misc_feature (21)..(21): n is a, c, g, or t
cttcctctgggaagcatcccngg

SEQ ID NO: 302 - DNA, 23 bp, Artificial Sequence
  Synthetic Oligonucleotide
  misc_feature (21)..(21): n is a, c, g, or t
cctccactggaaagcatcccngg

SEQ ID NO: 303 - DNA, 23 bp, Artificial Sequence
  Synthetic Oligonucleotide
  misc_feature (21)..(21): n is a, c, g, or t
cctcctccgggaagcaccccngg

SEQ ID NO: 304 - DNA, 23 bp, Artificial Sequence
  Synthetic Oligonucleotide
  misc_feature (21)..(21): n is a, c, g, or t
tggcccctgggaagcaccccngg

SEQ ID NO: 305 - DNA, 23 bp, Artificial Sequence
  Synthetic Oligonucleotide
  misc_feature (21)..(21): n is a, c, g, or t
tctcccctgggatgcatcccnga

SEQ ID NO: 306 - DNA, 23 bp, Artificial Sequence
  Synthetic Oligonucleotide
  misc_feature (21)..(21): n is a, c, g, or t
actcccctgggagctatcccngg

SEQ ID NO: 307 - DNA, 23 bp, Artificial Sequence
  Synthetic Oligonucleotide
  misc_feature (21)..(21): n is a, c, g, or t
cgtcctctgggaggcatcccngg

SEQ ID NO: 308 - DNA, 23 bp, Artificial Sequence
  Synthetic Oligonucleotide
  misc_feature (21)..(21): n is a, c, g, or t
tctcccctaggaaacataccngg

SEQ ID NO: 309 - DNA, 23 bp, Artificial Sequence
  Synthetic Oligonucleotide
  misc_feature (21)..(21): n is a, c, g, or t
actctcctgggaagcatcccngc

SEQ ID NO: 310 - DNA, 23 bp, Artificial Sequence
  Synthetic Oligonucleotide
  misc_feature (21)..(21): n is a, c, g, or t
gctcccccgggcggcatcccngg

SEQ ID NO: 311 - DNA, 23 bp, Artificial Sequence
  Synthetic Oligonucleotide
  misc_feature (21)..(21): n is a, c, g, or t
cctccccagggaggcatcctngg

SEQ ID NO: 312 - DNA, 23 bp, Artificial Sequence
  Synthetic Oligonucleotide
  misc_feature (21)..(21): n is a, c, g, or t
tctcccctgggaagcatcccngg

SEQ ID NO: 313 - DNA, 23 bp, Artificial Sequence
  Synthetic Oligonucleotide
  misc_feature (21)..(21): n is a, c, g, or t
gagttagagcagaagaagaangg

SEQ ID NO: 314 - DNA, 23 bp, Artificial Sequence
  Synthetic Oligonucleotide
  misc_feature (21)..(21): n is a, c, g, or t
gagtctaagcagaagaagaanag

SEQ ID NO: 315 - DNA, 23 bp, Artificial Sequence
  Synthetic Oligonucleotide
  misc_feature (21)..(21): n is a, c, g, or t
gaggccgagcagaagaaagangg

SEQ ID NO: 316 - DNA, 23 bp, Artificial Sequence
  Synthetic Oligonucleotide
  misc_feature (21)..(21): n is a, c, g, or t
gagtcctagcaggagaagaanag

SEQ ID NO: 317 - DNA, 23 bp, Artificial Sequence
  Synthetic Oligonucleotide
  misc_feature (21)..(21): n is a, c, g, or t
gagtccgggaaggagaagaangg

SEQ ID NO: 318 - DNA, 23 bp, Artificial Sequence
  Synthetic Oligonucleotide
  misc_feature (21)..(21): n is a, c, g, or t
acgtctgagcagaagaagaangg

SEQ ID NO: 319 - DNA, 23 bp, Artificial Sequence
  Synthetic Oligonucleotide
  misc_feature (21)..(21): n is a, c, g, or t
gaatccaagcaggagaagaanga

SEQ ID NO: 320 - DNA, 23 bp, Artificial Sequence
  Synthetic Oligonucleotide
  misc_feature (21)..(21): n is a, c, g, or t
gagccggagcagaagaaggangg

SEQ ID NO: 321 - DNA, 23 bp, Artificial Sequence
  Synthetic Oligonucleotide
  misc_feature (21)..(21): n is a, c, g, or t
tatctagcctcttctaagacngg

SEQ ID NO: 322 - DNA, 23 bp, Artificial Sequence
  Synthetic Oligonucleotide
  misc_feature (21)..(21): n is a, c, g, or t
tatctagcctcttctaaaacngg

SEQ ID NO: 323 - DNA, 23 bp, Artificial Sequence
  Synthetic Oligonucleotide
  misc_feature (21)..(21): n is a, c, g, or t
ttttgggagtaagaaaaggtngg

SEQ ID NO: 324 - DNA, 23 bp, Artificial Sequence
  Synthetic Oligonucleotide
  misc_feature (21)..(21): n is a, c, g, or t
atttggtagtaagaaaaggtngg

SEQ ID NO: 325 - DNA, 23 bp, Artificial Sequence
  Synthetic Oligonucleotide
  misc_feature (21)..(21): n is a, c, g, or t
ggatgggagtgagaaaaggtngg

SEQ ID NO: 326 - DNA, 23 bp, Artificial Sequence
  Synthetic Oligonucleotide
  misc_feature (21)..(21): n is a, c, g, or t
agaagggagtaagaaaaaggngg

SEQ ID NO: 327 - DNA, 23 bp, Artificial Sequence
  Synthetic Oligonucleotide
  misc_feature (21)..(21): n is a, c, g, or t
gcatgggagtaagagaaggangg

SEQ ID NO: 328 - DNA, 23 bp, Artificial Sequence
  Synthetic Oligonucleotide
  misc_feature (21)..(21): n is a, c, g, or t
actggggagaaagaaaaggcngg

SEQ ID NO: 329 - DNA, 23 bp, Artificial Sequence
  Synthetic Oligonucleotide
  misc_feature (21)..(21): n is a, c, g, or t
ctgggggactaagaaaaggtngg

SEQ ID NO: 330 - DNA, 23 bp, Artificial Sequence
  Synthetic Oligonucleotide
  misc_feature (21)..(21): n is a, c, g, or t
taggaggagtaagaaaaggtngg

SEQ ID NO: 331 - DNA, 23 bp, Artificial Sequence
  Synthetic Oligonucleotide
  misc_feature (21)..(21): n is a, c, g, or t
ccgggggcgtaagaaaaggtngg

SEQ ID NO: 332 - DNA, 23 bp, Artificial Sequence
  Synthetic Oligonucleotide
  misc_feature (21)..(21): n is a, c, g, or t
agatgggagtaagagaaggtntg

SEQ ID NO: 333 - DNA, 23 bp, Artificial Sequence
  Synthetic Oligonucleotide
  misc_feature (21)..(21): n is a, c, g, or t
gttggggagtaagagaaggangg

SEQ ID NO: 334 - DNA, 23 bp, Artificial Sequence
  Synthetic Oligonucleotide
  misc_feature (21)..(21): n is a, c, g, or t
ctaagggagtaagaaaaggangg

SEQ ID NO: 335 - DNA, 27 bp, Artificial Sequence
  Synthetic Oligonucleotide
  misc_feature (4)..(4): n is a, c, g, or t
attncccttcagctaaaataaaggagg

SEQ ID NO: 336 - DNA, 27 bp, Artificial Sequence
  Synthetic Oligonucleotide
  misc_feature (4)..(4): n is a, c, g, or t
attnggctcagcaggcacctgcctcag

SEQ ID NO: 337 - DNA, 27 bp, Artificial Sequence
  Synthetic Oligonucleotide
  misc_feature (4)..(4): n is a, c, g, or t
attngggactggagttgcttcatgtac

SEQ ID NO: 338 - DNA, 27 bp, Artificial Sequence
  Synthetic Oligonucleotide
  misc_feature (4)..(4): n is a, c, g, or t
attntctccatgaaaaatactggggtc

SEQ ID NO: 339 - DNA, 27 bp, Artificial Sequence
  Synthetic Oligonucleotide
  misc_feature (4)..(4): n is a, c, g, or t
attnttcatggagaaaatattcagaat

SEQ ID NO: 340 - DNA, 27 bp, Artificial Sequence
  Synthetic Oligonucleotide
  misc_feature (4)..(4): n is a, c, g, or t
attnttcatgaagaaaatattcaggaa

SEQ ID NO: 341 - DNA, 27 bp, Artificial Sequence
  Synthetic Oligonucleotide
  misc_feature (4)..(4): n is a, c, g, or t
attngcagctacaggcagagacaaagg

SEQ ID NO: 342 - DNA, 27 bp, Artificial Sequence
  Synthetic Oligonucleotide
  misc_feature (4)..(4): n is a, c, g, or t
attncctggaaaccatccaggccttgt

SEQ ID NO: 343 - DNA, 27 bp, Artificial Sequence
  Synthetic Oligonucleotide
  misc_feature (4)..(4): n is a, c, g, or t
attnggtcagctgttaacatcagtacg

SEQ ID NO: 344 - DNA, 27 bp, Artificial Sequence
  Synthetic Oligonucleotide
  misc_feature (4)..(4): n is a, c, g, or t
attncccttcagctaaaataaaggagg

SEQ ID NO: 345 - DNA, 27 bp, Artificial Sequence
  Synthetic Oligonucleotide
  misc_feature (4)..(4): n is a, c, g, or t
attnggctcagcaggcacctgcctcag

SEQ ID NO: 346 - DNA, 27 bp, Artificial Sequence
  Synthetic Oligonucleotide
  misc_feature (4)..(4): n is a, c, g, or t
attngggactggagttgcttcatgtac

SEQ ID NO: 347 - DNA, 27 bp, Artificial Sequence
  Synthetic Oligonucleotide
  misc_feature (4)..(4): n is a, c, g, or t
attntctccatgaaaaatactggggtc

SEQ ID NO: 348 - DNA, 27 bp, Artificial Sequence
  Synthetic Oligonucleotide
  misc_feature (4)..(4): n is a, c, g, or t
attntctccataaaaaatactagaaaa

SEQ ID NO: 349 - DNA, 27 bp, Artificial Sequence
  Synthetic Oligonucleotide
  misc_feature (4)..(4): n is a, c, g, or t
attnttcatggagaaaatattcagaat

SEQ ID NO: 350 - DNA, 27 bp, Artificial Sequence
  Synthetic Oligonucleotide
  misc_feature (4)..(4): n is a, c, g, or t
attnttcatgaagaaaatattcagaaa

SEQ ID NO: 351 - DNA, 27 bp, Artificial Sequence
  Synthetic Oligonucleotide
  misc_feature (4)..(4): n is a, c, g, or t
attngcagctacaggcagagacaaagg

SEQ ID NO: 352 - DNA, 27 bp, Artificial Sequence
  Synthetic Oligonucleotide
  misc_feature (4)..(4): n is a, c, g, or t
attncctggaaaccatccaggccttgt

SEQ ID NO: 353 - DNA, 27 bp, Artificial Sequence
  Synthetic Oligonucleotide
  misc_feature (4)..(4): n is a, c, g, or t
attnggtcagctgttaacatcagtacg

SEQ ID NO: 354 - DNA, 27 bp, Artificial Sequence
  Synthetic Oligonucleotide
  misc_feature (4)..(4): n is a, c, g, or t
attntcttcacggaaacagggttcctt

SEQ ID NO: 355 - DNA, 27 bp, Artificial Sequence
  Synthetic Oligonucleotide
  misc_feature (4)..(4): n is a, c, g, or t
attntcttcgcggaagcagggttccgg

SEQ ID NO: 356 - DNA, 27 bp, Artificial Sequence
  Synthetic Oligonucleotide
  misc_feature (4)..(4): n is a, c, g, or t
tttntggttgcccaccctagtcattgg

SEQ ID NO: 357 - DNA, 27 bp, Artificial Sequence
  Synthetic Oligonucleotide
  misc_feature (4)..(4): n is a, c, g, or t
tttngatggcgacttcaggcacaggat

SEQ ID NO: 358 - DNA, 27 bp, Artificial Sequence
  Synthetic Oligonucleotide
  misc_feature (4)..(4): n is a, c, g, or t
attntgcagagcaaataccagagataa

SEQ ID NO: 359 - DNA, 27 bp, Artificial Sequence
  Synthetic Oligonucleotide
  misc_feature (4)..(4): n is a, c, g, or t
attntgtacataaaatatcaaagtaca

SEQ ID NO: 360 - DNA, 27 bp, Artificial Sequence
  Synthetic Oligonucleotide
  misc_feature (4)..(4): n is a, c, g, or t
tttncctcactcctgctcggtgaattt

SEQ ID NO: 361 - DNA, 27 bp, Artificial Sequence
  Synthetic Oligonucleotide
  misc_feature (4)..(4): n is a, c, g, or t
attntcttcacggaaacagggttcctt

SEQ ID NO: 362 - DNA, 27 bp, Artificial Sequence
  Synthetic Oligonucleotide
  misc_feature (4)..(4): n is a, c, g, or t
attntcttcgcggaagcagggttccgg

SEQ ID NO: 363 - DNA, 27 bp, Artificial Sequence
  Synthetic Oligonucleotide
  misc_feature (4)..(4): n is a, c, g, or t
tttntggttgcccaccctagtcattgg

SEQ ID NO: 364 - DNA, 27 bp, Artificial Sequence
  Synthetic Oligonucleotide
  misc_feature (4)..(4): n is a, c, g, or t
tttngatggcgacttcaggcacaggat

SEQ ID NO: 365 - DNA, 27 bp, Artificial Sequence
  Synthetic Oligonucleotide
  misc_feature (4)..(4): n is a, c, g, or t
attntgcagagcaaataccagagataa

SEQ ID NO: 366 - DNA, 27 bp, Artificial Sequence
  Synthetic Oligonucleotide
  misc_feature (4)..(4): n is a, c, g, or t
attnctgacctcccaaacagctacata

SEQ ID NO: 367 - DNA, 27 bp, Artificial Sequence
  Synthetic Oligonucleotide
  misc_feature (4)..(4): n is a, c, g, or t
attntcagagggacacactgtggcccc

SEQ ID NO: 368 - DNA, 44 bp, Artificial Sequence
  Synthetic Oligonucleotide
tctctcattctgcagagcaaataccagagataagagagtaggct

SEQ ID NO: 369 - DNA, 23 bp, Artificial Sequence
  Synthetic Oligonucleotide
tctccatgaaaaatactggggtc

SEQ ID NO: 370 - DNA, 23 bp, Artificial Sequence
  Synthetic Oligonucleotide
cctggaaaccatccaggccttgt

SEQ ID NO: 371 - DNA, 23 bp, Artificial Sequence
  Synthetic Oligonucleotide
gcagctacaggcagagacaaagg

SEQ ID NO: 372 - DNA, 23 bp, Artificial Sequence
  Synthetic Oligonucleotide
tgcagagcaaataccagagataa

SEQ ID NO: 373 - DNA, 23 bp, Artificial Sequence
  Synthetic Oligonucleotide
ggtcagctgttaacatcagtacg

SEQ ID NO: 374 - DNA, 23 bp, Artificial Sequence
  Synthetic Oligonucleotide
tcagagggacacactgtggcccc

SEQ ID NO: 375 - DNA, 44 bp, Artificial Sequence; identical to SEQ ID NO: 368
  Synthetic Oligonucleotide

SEQ ID NO: 376 - DNA, 44 bp, Artificial Sequence; identical to SEQ ID NO: 368
  Synthetic Oligonucleotide

SEQ ID NO: 377 - DNA, 44 bp, Artificial Sequence
  Synthetic Oligonucleotide
tggcacattgtcagagggacacactgtggcccctgtgcccagcc

SEQ ID NO: 378 - DNA, 44 bp, Artificial Sequence
  Synthetic Oligonucleotide
gctgtcatttcctggaaaccatccaggccttgtagcctgccctc

SEQ ID NO: 379 - protein, 1147 aa, Alicyclobacillus kakegawensis
MAVKSIKVKLRLSECPDILAGMWQLHRATNAGVRYYTEWVSLMRQEILYSRGPDGGQQCYMTAEDCQRELLRRLRNRQLHNGRQDQPGTDADLLAISRRLYEILVLQSIGKRGDAQQIASSFLSPLVDPNSKGGRGEAKSGRKPAWQKMRDQGDPRWVAAREKYEQRKAVDPSKEILNSLDALGLRPLFAVFTETYRSGVDWKPLGKSQGVRTWDRDMFQQALERLMSWESWNRRVGEEYARLFQQKMKFEQEHFAEQSHLVKLARALEADMRAASQGFEAKRGTAHQITRRALRGADRVFEIWKSIPEEALFSQYDEVIRQVQAEKRRDFGSHDLFAKLAEPKYQPLWRADETFLTRYALYNGVLRDLEKARQFATFTLPDACVNPIWTRFESSQGSNLHKYEFLFDHLGPGRHAVRFQRLLVVESEGAKERDSVVVPVAPSGQLDKLVLREEEKSSVALHLHDTARPDGFMAEWAGAKLQYERSTLARKARRDKQGMRSWRRQPSMLMSAAQMLEDAKQAGDVYLNISVRVKSPSEVRGQRRPPYAALFRIDDKQRRVTVNYNKLSAYLEEHPDKQIPGAPGLLSGLRVMSVDLGLRTSASISVFRVAKKEEVEALGDGRPPHYYPIHGTDDLVAVHERSHLIQMPGETETKQLRKLREERQAVLRPLFAQLALLRLLVRCGAADERIRTRSWQRLTKQGREFTKRLTPSWREALELELTRLEAYCGRVPDDEWSRIVDRTVIALWRRMGKQVRDWRKQVKSGAKVKVKGYQLDVVGGNSLAQIDYLEQQYKFLRRWSFFARASGLVVRADRESHFAVALRQHIENAKRDRLKKLADRILMEALGYVYEASGPREGQWTAQHPPCQLIILEELSAYRFSDDRPPSENSKLMAWGHRGILEELVNQAQVHDVLVGTVYAAFSSRFDARTGAPGVRCRRVPARFVGATVDDSLPLWLTEFLDKHRLDKNLLRPDDVIPTGEGEFLVSPCGEEAARVRQVHADINAAQNLQRRLWQNFDITELRLRCDVKMGGEGTVLVPRVNNARAKQLFGKKVLVSQDGVTFFERSQTGGKPHSEKQTDLTDKELELIAEADEARAKSVVLFRDPSGHIGKGHWIRQREFWSLVKQRIESHTAERIRVRGVGSSLD

SEQ ID NO: 380 - protein, 1112 aa, Bacillus species
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 381 - protein, 1489 aa, Desulfatirhabdium butyrativorans
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 382 - protein, 1194 aa, Desulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 383 - protein, 1326 aa, Unknown
  Lentisphaeria bacterium
MAVELNRIYQGRVNHVYIFDENQNQVSVDNGDDLLFVHHELYQDAINYYLVALAAMALDSKDSLFGKFKMQIRAVWNDFYRNGQLRPGLKHSLIRSLGHAAELNTSNGADIAMNLILEDGGIPSEILNAALEHLAEKCTGDVSQLGKTFFPRFCDTAYHGNWDVDAKSFSEKKGRQRLVDALYSLHPVQAVQELAPEIEIGWGGVKTQTGKFFTGDEAKASLKKAISYFLQDTGKNSPELQEYFSVAGKQPLEQYLGKIDTFPEISFGRISSHQNINISNAMWILKFFPDQYSVDLIKNLIPNKKYEIGIAPQWGDDPVKLSRGKRGYTFRAFTDLAMWEKNWKVFDRAAFSDALKTINQFRNKTQERNDQLKRYCAALNWMDGESSDKKPPVEPADADAVDEAATSVLPILAGDKRWNALLQLQKELGICNDFTENELMDYGLSLRTIRGYQKLRSMMLEKEEKMRAKTADDEEISQALQEIIIKFQSSHRDTIGSVSLFLKLAEPKYFCVWHDADKNQNFASVDMVADAVRYYSYQEEKARLEEPIQITPADARYSRRVSDLYALVYKNAKECKTGYGLRPDGNFVFEIAQKNAKGYAPAKVVLAFSAPRLKRDGLIDKEFSAYYPPVLQAFLREEEAPKQSFKTTAVILMPDWDKNGKRRILLNFPIKLDVSAIHQKTDHRFENQFYFANNTNTCLLWPSYQYKKPVTWYQGKKPFDVVAVDLGQRSAGAVSRITVSTEKREHSVAIGEAGGTQWYAYRKFSGLLRLPGEDATVIRDGQRTEELSGNAGRLSTEEETVQACVLCKMLIGDATLLGGSDEKTIRSFPKQNDKLLIAFRRATGRMKQLQRWLWMLNENGLCDKAKTEISNSDWLVNKNIDNVLKEEKQHREMLPAILLQIADRVLPLRGRKWDWVLNPQSNSFVLQQTAHGSGDPHKKICGQRGLSFARIEQLESLRMRCQALNRILMRKTGEKPATLAEMRNNPIPDCCPDILMRLDAMKEQRINQTANLILAQALGLRHCLHSESATKRKENGMHGEYEKIPGVEPAAFVVLEDLSRYRFSQDRSSYENSRLMKWSHRKILEKLALLCEVFNVPILQVGAAYSSKFSANAIPGFRAEECSIDQLSFYPWRELKDSREKALVEQIRKIGHRLLTFDAKATIIMPRNGGPVFIPFVPSDSKDTLIQADINASFNIGLRGVADATNLLCNNRVSCDRKKDCWQVKRSSNFSKMVYPEKLSLSFDPIKKQEGAGGNFFVLGCSERILTGTSEKSPVFTSSEMAKKYPNLMFGSALWRNEILKLERCCKINQSRLDKFIAKKEVQNEL

SEQ ID NO: 384 - protein, 1090 aa, Laceyella sediminis
MSIRSFKLKIKTKSGVNAEELRRGLWRTHQLINDGIAYYMNWLVLLRQEDLFIRNEETNEIEKRSKEEIQGELLERVHKQQQRNQWSGEVDDQTLLQTLRHLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTELFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSYERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 385 - protein, 1041 aa, Methylobacterium nodulans
MYEAIVLADDANAQLANAFLGPLTDPNSAGFLEAFNKVDRPAPSWLDQVPASDPIDPAVLAEANAWLDTDAGRAWLVDTGAPPRWRSLAAKQDPIWPREFARKLGELRKEAASGTSAIIKALKRDFGVLPLFQPSLAPRILGSRSSLTPWDRLAFRLAVGHLLSWESWCTRARDEHTARVQRLEQFSSAHLKGDLATKVSTLREYERARKEQIAQLGLPMGERDFLITVRMTRGWDDLREKWRRSGDKGQEALHAIIATEQTRKRGRFGDPDLFRWLARPENHHVWADGHADAVGVLARVNAMERLVERSRDTALMTLPDPVAHPRSAQWEAEGGSNLRNYQLEAVGGELQITLPLLKAADDGRCIDTPLSFSLAPSDQLQGVVLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 386 - protein, 1388 aa, Unknown
  Opitutaceae bacterium
MSLNRIYQGRVAAVETGTALAKGNVEWMPAAGGDEVLWQHHELFQAAINYYLVALLALADKNNPVLGPLISQMDNPQSPYHVWGSFRRQGRQRTGLSQAVAPYITPGNNAPTLDEVFRSILAGNPTDRATLDAALMQLLKACDGAGAIQQEGRSYWPKFCDPDSTANFAGDPAMLRREQHRLLLPQVLHDPAITHDSPALGSFDTYSIATPDTRTPQLTGPKARARLEQAITLWRVRLPESAADFDRLASSLKKIPDDDSRLNLQGYVGSSAKGEVQARLFALLLFRHLERSSFTLGLLRSATPPPKNAETPPPAGVPLPAASAADPVRIARGKRSFVFRAFTSLPCWHGGDNIHPTWKSFDIAAFKYALTVINQIEEKTKERQKECAELETDFDYMHGRLAKIPVKYTTGEAEPPPILANDLRIPLLRELLQNIKVDTALTDGEAVSYGLQRRTIRGFRELRRIWRGHAPAGTVFSSELKEKLAGELRQFQTDNSTTIGSVQLFNELIQNPKYWPIWQAPDVETARQWADAGFADDPLAALVQEAELQEDIDALKAPVKLTPADPEYSRRQYDFNAVSKFGAGSRSANRHEPGQTERGHNTFTTEIAARNAADGNRWRATHVRIHYSAPRLLRDGLRRPDTDGNEALEAVPWLQPMMEALAPLPTLPQDLTGMPVFLMPDVTLSGERRILLNLPVTLEPAALVEQLGNAGRWQNQFFGSREDPFALRWPADGAVKTAKGKTHIPWHQDRDHFTVLGVDLGTRDAGALALLNVTAQKPAKPVHRIIGEADGRTWYASLADARMIRLPGEDARLFVRGKLVQEPYGERGRNASLLEWEDARNIILRLGQNPDELLGADPRRHSYPEINDKLLVALRRAQARLARLQNRSWRLRDLAESDKALDEIHAERAGEKPSPLPPLARDDAIKSTDEALLSQRDIIRRSFVQIANLILPLRGRRWEWRPHVEVPDCHILAQSDPGTDDTKRLVAGQRGISHERIEQIEELRRRCQSLNRALRHKPGERPVLGRPAKGEEIADPCPALLEKINRLRDQRVDQTAHAILAAALGVRLRAPSKDRAERRHRDIHGEYERFRAPADFVVIENLSRYLSSQDRARSENTRLMQWCHRQIVQKLRQLCETYGIPVLAVPAAYSSRFSSRDGSAGFRAVHLTPDHRHRMPWSRILARLKAHEEDGKRLEKTVLDEARAVRGLFDRLDRFNAGHVPGKPWRTLLAPLPGGPVFVPLGDATPMQADLNAAINIALRGIAAPDRHDIHHRLRAENKKRILSLRLGTQREKARWPGGAPAVTLSTPNNGASPEDSDALPERVSNLFVDIAGVANFERVTIEGVSQKFATGRGLWASVKQRAWNRVARLNETVTDNNRNEEEDDIPM

SEQ ID NO: 387 - protein, 1108 aa, Bacillus species
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 388 - protein, 658 aa, Methylobacterium nodulans
MLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 389 - protein, 1147 aa, Alicyclobacillus kakegawensis; identical to SEQ ID NO: 379

SEQ ID NO: 390 - protein, 1112 aa, Bacillus species; identical to SEQ ID NO: 380

SEQ ID NO: 391 - protein, 1326 aa, Unknown; identical to SEQ ID NO: 383
  Lentisphaeria bacterium

SEQ ID NO: 392 - protein, 1090 aa, Laceyella sediminis; identical to SEQ ID NO: 384

SEQ ID NO: 393 - protein, 15 aa, Artificial Sequence
  Synthetic Peptide
GGGGSGGGGSGGGGS

SEQ ID NO: 394 - protein, 30 aa, Artificial Sequence
  Synthetic Peptide
GGGGSGGGGSGGGGSGGGGSGGGGSGGGGS

SEQ ID NO: 395 - protein, 45 aa, Artificial Sequence
  Synthetic Peptide
GGGGSGGGGSGGGGSGGGGSGGGGSGGGGSGGGGSGGGGSGGGGS

SEQ ID NO: 396 - protein, 60 aa, Artificial Sequence
  Synthetic Peptide
GGGGSGGGGSGGGGSGGGGSGGGGSGGGGSGGGGSGGGGSGGGGSGGGGSGGGGSGGGGS

SEQ ID NO: 397 - DNA, 12 bp, Artificial Sequence
  Synthetic Oligonucleotide
acttgtttaagt

SEQ ID NO: 398 - DNA, 12 bp, Artificial Sequence
  Synthetic Oligonucleotide
  misc_feature (1)..(4): n = any nucleotide that is complementary to nnnn at positions 9-12
  misc_feature (9)..(12): n = any nucleotide that is complementary to nnnn at positions 1-4
nnnngtttnnnn

SEQ ID NO: 399 - DNA, 16 bp, Artificial Sequence
  Synthetic Oligonucleotide
ggcaccgagtcggtgc

SEQ ID NO: 400 - DNA, 17 bp, Artificial Sequence
  Synthetic Oligonucleotide
  misc_feature (1)..(7): n = any nucleotide that is complementary to nnnnnnn at positions 11 to 17
  misc_feature (11)..(17): n = any nucleotide that is complementary to nnnnnnn at positions 1 to 7
nnnnnnnagtnnnnnnn

SEQ ID NO: 401 - RNA, 30 nt, Artificial Sequence
  Synthetic Oligonucleotide
  misc_feature (2)..(5): y = t/u or c
  misc_feature (8)..(20): n = any nucleotide
  misc_feature (8)..(8): n= bulge in a duplex
  misc_feature (21)..(23): n= bulge in a duplex
  misc_feature (23)..(23): n = any nucleotide
  misc_feature (26)..(29): r = g or a
gyyyyagnnnnnnnnnnnnnaanuurrrru

SEQ ID NO: 402 - protein, 4 aa, Artificial Sequence
  Synthetic Peptide
GGGS

SEQ ID NO: 403 - protein, 5 aa, Artificial Sequence
  Synthetic Peptide
GGGGS

SEQ ID NO: 404 - protein, 9 aa, Artificial Sequence
  Synthetic Peptide
GGSGGSGGS

SEQ ID NO: 405 - protein, 25 aa, Artificial Sequence
  Synthetic Peptide
GGGGSGGGGSGGGGSGGGGSGGGGS

SEQ ID NO: 406 - protein, 35 aa, Artificial Sequence
  Synthetic Peptide
GGGGSGGGGSGGGGSGGGGSGGGGSGGGGSGGGGS

SEQ ID NO: 407 - protein, 10 aa, Artificial Sequence
  Synthetic Peptide
GGGGSGGGGS

SEQ ID NO: 408 - protein, 20 aa, Artificial Sequence
  Synthetic Peptide
GGGGSGGGGSGGGGSGGGGS

SEQ ID NO: 409 - protein, 40 aa, Artificial Sequence
  Synthetic Peptide
GGGGSGGGGSGGGGSGGGGSGGGGSGGGGSGGGGSGGGGS

SEQ ID NO: 410 - protein, 50 aa, Artificial Sequence
  Synthetic Peptide
GGGGSGGGGSGGGGSGGGGSGGGGSGGGGSGGGGSGGGGSGGGGSGGGGS

SEQ ID NO: 411 - protein, 55 aa, Artificial Sequence
  Synthetic Peptide
GGGGSGGGGSGGGGSGGGGSGGGGSGGGGSGGGGSGGGGSGGGGSGGGGSGGGGS

SEQ ID NO: 412 - protein, 32 aa, Artificial Sequence
  Synthetic Peptide
LEPGEKPYKCPECGKSFSQSGALTRHQRTHTR

SEQ ID NO: 413 - protein, 20 aa, Artificial Sequence
  Synthetic Peptide
PKKKRKVEASSPKKRKVEAS

SEQ ID NO: 414 - DNA, 9 bp, Artificial Sequence
  Synthetic Oligonucleotide
ggtggtagt

SEQ ID NO: 415 - DNA, 27 bp, Artificial Sequence
  Synthetic Oligonucleotide
ggtggtagtggagggagcggcggttca

SEQ ID NO: 416 - DNA, 72 bp, Artificial Sequence
  Synthetic Oligonucleotide
ggtggaggaggctctggtggaggcggtagcggaggcggagggtcgggtggtagtggagggagcggcggttca

SEQ ID NO: 417 - DNA, 48 bp, Artificial Sequence
  Synthetic Oligonucleotide
tcgggatctgagacgcctgggacctcggaatcggctacgcccgaaagt

SEQ ID NO: 418 - DNA, 192 bp, Artificial Sequence
  Synthetic Oligonucleotide
gtggataacaaatttaacaaagaaatgtgggcggcgtgggaagaaattcgtaacctgccgaacctgaacggctggcagatgaccgcgtttattgcgagcctggtggatgatccgagccagagcgcgaacctgctggcggaagcgaaaaaactgaacgatgcgcaggcgccgaaaaccggcggtggttctggt

SEQ ID NO: 419 - DNA, 108 bp, Artificial Sequence
  Synthetic Oligonucleotide
ggtggttctgccggtggctccggttctggctccagcggtggcagctctggtgcgtccggcacgggtactgcgggtggcactggcagcggttccggtactggctctggc

SEQ ID NO: 420 - protein, 284 aa, Artificial Sequence
  Synthetic Peptide
GFGDVGALESLRGNADLAYILSMEPCGHCLIINNVNFCRESGLRTRTGSNIDCEKLRRRFSSLHFMVEVKGDLTAKKMVLALLELARQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSVD

SEQ ID NO: 421 - protein, 263 aa, Artificial Sequence
  Synthetic Peptide
SESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 422 - protein, 147 aa, Artificial Sequence
  Synthetic Peptide
SGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETD

SEQ ID NO: 423 - protein, 118 aa, Artificial Sequence
  Synthetic Peptide
GESLFKGPRDYNPISSTICHLTNESDGHTTSLYGIGFGPFIITNKHLFRRNNGTLLVQSLHGVFKVKNTTTLQQHLIDGRDMIIIRMPKDFPPFPQKLKFREPQREERICLVTTNFQT

SEQ ID NO: 424 - protein, 101 aa, Artificial Sequence
  Synthetic Peptide
KSMSSMVSDTSCTFPSSDGIFWKHWIQTKDGQCGSPLVSTRDGFIVGIHSASNFTNTNNYFTSVPKNFMELLTNQEAQQWVSGWRLNADSVLWGGHKVFMV

SEQ ID NO: 425 - protein, 939 aa, Artificial Sequence
  Synthetic Peptide
ATGGCAGATGATCAGGGCTGTATTGAAGAGCAGGGGGTTGAGGATTCAGCAAATGAAGATTCAGTGGAAAATCTCTACTTCCAGGCTAAGCCAGACCGGTCCTCGTTTGTACCGTCCCTCTTCAGTAAGAAGAAGAAAAATGTCACCATGCGATCCATCAAGACCACCCGGGACCGAGTGCCTACATATCAGTACAACATGAATTTTGAAAAGCTGGGCAAATGCATCATAATAAACAACAAGAACTTTGATAAAGTGACAGGTATGGGCGTTCGAAACGGAACAGACAAAGATGCCGAGGCGCTCTTCAAGTGCTTCCGAAGCCTGGGTTTTGACGTGATTGTCTATAATGACTGCTCTTGTGCCAAGATGCAAGATCTGCTTAAAAAAGCTTCTGAAGAGGACCATACAAATGCCGCCTGCTTCGCCTGCATCCTCTTAAGCCATGGAGAAGAAAATGTAATTTATGGGAAAGATGGTGTCACACCAATAAAGGATTTGACAGCCCACTTTAGGGGGGATAGATGCAAAACCCTTTTAGAGAAACCCAAACTCTTCTTCATTCAGGCTTGCCGAGGGACCGAGCTTGATGATGGCATCCAGGCCGAAAATCTCTACTTCCAGTCGGGGCCCATCAATGACACAGATGCTAATCCTCGATACAAGATCCCAGTGGAAGCTGACTTCCTCTTCGCCTATTCCACGGTTCCAGGCTATTACTCGTGGAGGAGCCCAGGAAGAGGCTCCTGGTTTGTGCAAGCCCTCTGCTCCATCCTGGAGGAGCACGGAAAAGACCTGGAAATCATGCAGATCCTCACCAGGGTGAATGACAGAGTTGCCAGGCACTTTGAGTCTCAGTCTGATGACCCACACTTCCATGAGAAGAAGCAGATCCCCTGTGTGGTCTCCATGCTCACCAAGGAACTCTACTTCAGTCAA

SEQ ID NO: 426 - protein, 861 aa, Artificial Sequence
  Synthetic Peptide
ATGGAGAACACTGAAAACTCAGTGGATTCAAAATCCATTAAAAATTTGGAACCAAAGATCATACATGGAAGCGAATCAATGGAAAATCTCTACTTCCAGTCTGGAATATCCCTGGACAACAGTTATAAAATGGATTATCCTGAGATGGGTTTATGTATAATAATTAATAATAAGAATTTTCATAAAAGCACTGGAATGACATCTCGGTCTGGTACAGATGTCGATGCAGCAAACCTCAGGGAAACATTCAGAAACTTGAAATATGAAGTCAGGAATAAAAATGATCTTACACGTGAAGAAATTGTGGAATTGATGCGTGATGTTTCTAAAGAAGATCACAGCAAAAGGAGCAGTTTTGTTTGTGTGCTTCTGAGCCATGGTGAAGAAGGAATAATTTTTGGAACAAATGGACCTGTTGACCTGAAAAAAATAACAAACTTTTTCAGAGGGGATCGTTGTAGAAGTCTAACTGGAAAACCCAAACTTTTCATTATTCAGGCCTGCCGTGGTACAGAACTGGACTGTGGCATTGAGACAGAAAATCTCTACTTCCAGAGTGGTGTTGATGATGACATGGCGTGTCATAAAATACCAGTGGAGGCCGACTTCTTGTATGCATACTCCACAGCACCTGGTTATTATTCTTGGCGAAATTCAAAGGATGGCTCCTGGTTCATCCAGTCGCTTTGTGCCATGCTGAAACAGTATGCCGACAAGCTTGAATTTATGCACATTCTTACCCGGGTTAACCGAAAGGTGGCAACAGAATTTGAGTCCTTTTCCTTTGACGCTACTTTTCATGCAAAGAAACAGATTCCATGTATTGTTTCCATGCTCACAAAAGAACTCTATTTTTATCAC

SEQ ID NO: 427 - protein, 164 aa, Artificial Sequence
  Synthetic Peptide
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRGGSEVSALEKEVSALEKEVSALEKEVSALEKEVSALEKGGS

SEQ ID NO: 428 - protein, 239 aa, Artificial Sequence
  Synthetic Peptide
MGGSKVSALKEKVSALKEKVSALKEKVSALKEKVSALKEGGSPPQRDVAEPQAFFRRTNSAIRRLQAAETLESACAAAAQEVRKITGYDRVMIYRFASDFSGEVIAEDRCAEVESKLGLHYPASTVPAQARRLYTINPVRIIPDINYRPVPVTPYLNPVTGRPIDLSFAILRSVSPVHLEFMRNIGMHGTMSISILRGERLWGLIVCHHRTPYYVDLDGRQACELVAQVLARQIGVMEE

SEQ ID NO: 429 - protein, 154 aa, Artificial Sequence
  Synthetic Peptide
MVSKGEELFTGVVPILVELDGDVNGHKFSVSGEGEGDATYGKLTLKLICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYIT

SEQ ID NO: 430 - protein, 85 aa, Artificial Sequence
  Synthetic Peptide
ADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 431 - protein, 156 aa, Artificial Sequence
  Synthetic Peptide
SKGERLFRGKVPILVELKGDVNGHKFSVRGEGKGDATRGKLTLKFICTTGKLPVPWPTLVTTLTYGVQCFSRYPKHMKRHDFFKSAMPKGYVQERTISFKKDGKYKTRAEVKFEGRTLVNRIKLKGRDFKEKGNILGHKLRYNFNSHKVYITADKR

SEQ ID NO: 432 - protein, 81 aa, Artificial Sequence
  Synthetic Peptide
KNGIKAKFKIRHNVKDGSVQLADHYQQNTPIGRGPVLLPRNHYLSTRSKLSKDPKEKRDHMVLLEFVTAAGIKHGRDERYK

SEQ ID NO: 433 - protein, 229 aa, Rattus rattus [sequence omitted]

SEQ ID NO: 434 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 435 - protein, 325 aa, Homo sapiens
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 436 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 437 - protein, 200 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPYLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLLD

SEQ ID NO: 438 - protein, 181 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 439 - RNA, 25 nt, Artificial Sequence
  Synthetic Oligonucleotide
gggaacaaagcugaaguacuuaccc

SEQ ID NO: 440 - DNA, 18 bp, Artificial Sequence
  Synthetic Oligonucleotide
gggtagggcgggttggga

SEQ ID NO: 441 - DNA, 25 bp, Artificial Sequence
  Synthetic Oligonucleotide
  misc_feature (25)..(25): 3' Thiol modification
ttataactattcctaaaaaaaaaaa

SEQ ID NO: 442 - DNA, 26 bp, Artificial Sequence
  Synthetic Oligonucleotide
  misc_feature (1)..(1): 5' Thiol modification
aaaaaaaaaactcccctaataacaat

SEQ ID NO: 443 - RNA, 45 nt, Artificial Sequence
  Synthetic Oligonucleotide
ggguaggaauaguuauaauuucccuuucccauuguuauuagggag

SEQ ID NO: 444 - RNA, 12 nt, Artificial Sequence
  Synthetic Oligonucleotide
  misc_feature (1)..(1): 5' biotin modification
  misc_feature (12)..(12): 3' quencher
  misc_feature (12)..(12): 3' quencher
  misc_feature (12)..(12): 3' quencher
  misc_feature (12)..(12): 3' quencher
ucucguacguuc

SEQ ID NO: 445 - RNA, 24 nt, Artificial Sequence
  Synthetic Oligonucleotide
  misc_feature (1)..(1): 5' biotin modification
  misc_feature (24)..(24): 3' quencher
  misc_feature (24)..(24): 3' quencher
  misc_feature (24)..(24): 3' quencher
ucucguacguucucucguacguuc

SEQ ID NO: 446 - DNA, 66 bp, Artificial Sequence
  Synthetic Oligonucleotide
tgtggttggtgtggttggttcatggtcatattggtttttttttttttttccaaccacagtctctgt

SEQ ID NO: 447 - DNA, 35 bp, Artificial Sequence
  Synthetic Oligonucleotide
ggttggtagtctcgaattgctctctttcactggcc

SEQ ID NO: 448 - DNA, 48 bp, Artificial Sequence
  Synthetic Oligonucleotide
gaaattaatacgactcactatagggggttggttcatggtcatattggt

SEQ ID NO: 449 - DNA, 57 bp, Artificial Sequence
  Synthetic Oligonucleotide
gaaattaatacgactcactatagggggttggtgtggttggttcatggtcatattggt

SEQ ID NO: 450 - DNA, 31 bp, Artificial Sequence
  Synthetic Oligonucleotide
ggccagtgaaagagagcaattcgagactacc

SEQ ID NO: 451 - RNA, 64 nt, Artificial Sequence
  Synthetic Oligonucleotide
gauuuagacuaccccaaaaacgaaggggacuaaaacccagugaaagagagcaauucgagacuac

SEQ ID NO: 452 - RNA, 64 nt, Artificial Sequence
  Synthetic Oligonucleotide
gauuuagacuaccccaaaaacgaaggggacuaaaacaaagagagcaauucgagacuaccaacca

SEQ ID NO: 453 - RNA, 64 nt, Artificial Sequence
  Synthetic Oligonucleotide
gauuuagacuaccccaaaaacgaaggggacuaaaacagacuaccaaccacagagacugugguug

SEQ ID NO: 454 - DNA, 106 bp, Artificial Sequence
  Synthetic Oligonucleotide
gttagatcgcaagcatatcattgcgcttgcgatctaactgctgcgccgccgggaaaatactgtacggttagatcgcatagtctcgaattgctctctttcactggcc

SEQ ID NO: 455 - DNA, 71 bp, Artificial Sequence
  Synthetic Oligonucleotide
gttagatcgcaagcatatcattgcgcttgcgatctaactgctgcgccgccgggaaaatactgtacggttag

SEQ ID NO: 456 - DNA, 35 bp, Artificial Sequence
  Synthetic Oligonucleotide
atcgcatagtctcgaattgctctctttcactggcc

SEQ ID NO: 457 - DNA, 50 bp, Artificial Sequence
  Synthetic Oligonucleotide
gaaattaatacgactcactatagggatcgcaagcatatcattgcgcttgc

SEQ ID NO: 458 - DNA, 31 bp, Artificial Sequence
  Synthetic Oligonucleotide
ggccagtgaaagagagcaattcgagactatg

SEQ ID NO: 459 - RNA, 64 nt, Artificial Sequence
  Synthetic Oligonucleotide
gauuuagacuaccccaaaaacgaaggggacuaaaacccagugaaagagagcaauucgagacuau

SEQ ID NO: 460 - RNA, 64 nt, Artificial Sequence
  Synthetic Oligonucleotide
gauuuagacuaccccaaaaacgaaggggacuaaaacagagcaauucgagacuaugcgaucuaac

SEQ ID NO: 461 - RNA, 64 nt, Artificial Sequence
  Synthetic Oligonucleotide
gauuuagacuaccccaaaaacgaaggggacuaaaacacuaugcgaucuaaccguacaguauuuu

SEQ ID NO: 462 - protein, 7 aa, Artificial Sequence
  Synthetic Peptide
PKKKRKV

SEQ ID NO: 463 - protein, 16 aa, Artificial Sequence
  Synthetic Peptide
KRPAATKKAGQAKKKK

SEQ ID NO: 464 - protein, 9 aa, Artificial Sequence
  Synthetic Peptide
PAAKRVKLD

SEQ ID NO: 465 - protein, 11 aa, Artificial Sequence
  Synthetic Peptide
RQRRNELKRSP

SEQ ID NO: 466 - protein, 38 aa, Artificial Sequence
  Synthetic Peptide
NQSSNFGPMKGGNFGGRSSGPYGGGGQYFAKPRNQGGY

SEQ ID NO: 467 - protein, 42 aa, Artificial Sequence
  Synthetic Peptide
RMRIZFKNKGKDTAELRRRRVEVSVELRKAKKDEQILKRRNV

SEQ ID NO: 468 - protein, 8 aa, Artificial Sequence
  Synthetic Peptide
VSRKRPRP

SEQ ID NO: 469 - protein, 8 aa, Artificial Sequence
  Synthetic Peptide
PPKKARED

SEQ ID NO: 470 - protein, 8 aa, Artificial Sequence
  Synthetic Peptide
PQPKKKPL

SEQ ID NO: 471 - protein, 12 aa, Artificial Sequence
  Synthetic Peptide
SALIKKKKKMAP

SEQ ID NO: 472 - protein, 5 aa, Artificial Sequence
  Synthetic Peptide
DRLRR

SEQ ID NO: 473 - protein, 7 aa, Artificial Sequence
  Synthetic Peptide
PKQKKRK

SEQ ID NO: 474 - protein, 10 aa, Artificial Sequence
  Synthetic Peptide
RKLKKKIKKL

SEQ ID NO: 475 - protein, 10 aa, Artificial Sequence
  Synthetic Peptide
REKKKFLKRR

SEQ ID NO: 476 - protein, 20 aa, Artificial Sequence
  Synthetic Peptide
KRKGDEVDGVDEVAKKKSKK

SEQ ID NO: 477 - protein, 17 aa, Artificial Sequence
  Synthetic Peptide
RKCLQAGMNLEARKTKK

SEQ ID NO: 478 - protein, 107 aa, Homo sapiens
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 479 - protein, 107 aa, Homo sapiens; identical to SEQ ID NO: 478

SEQ ID NO: 480 - DNA, 20 bp, Artificial Sequence
  Synthetic Oligonucleotide
gccaaattggacgaccctcg

SEQ ID NO: 481 - DNA, 20 bp, Artificial Sequence
  Synthetic Oligonucleotide
cgaggagacccccgtttcgg

SEQ ID NO: 482 - DNA, 20 bp, Artificial Sequence
  Synthetic Oligonucleotide
cccgccgccgccgtggctcg

SEQ ID NO: 483 - DNA, 20 bp, Artificial Sequence
  Synthetic Oligonucleotide
tgagctctacgagatccaca

SEQ ID NO: 484 - protein, 1145 aa, Alicyclobacillus macrosporangiidus
MVAVKSIKVKLMLGHLPEIREGLWHLHEAVNLGVRYYTEWLALLRQGNLYRRGKDGAQECYMTAEQCRQELLVRLRDRQKRNGHTGDPGTDEELLGVARRLYELLVPQSVGKKGQAQMLASGFLSPLADPKSEGGKGTSKSGRKPAWMGMKEAGDSRWVEAKARYEANKAKDPTKQVIASLEMYGLRPLFDVFTETYKTIRWMPLGKHQGVRAWDRDMFQQSLERLMSWESWNERVGAEFARLVDRRDRFREKHFTGQEHLVALAQRLEQEMKEASPGFESKSSQAHRITKRALRGADGIIDDWLKLSEGEPVDRFDEILRKRQAQNPRRFGSHDLFLKLAEPVFQPLWREDPSFLSRWASYNEVLNKLEDAKQFATFTLPSPCSNPVWARFENAEGTNIFKYDFLFDHFGKGRHGVRFQRMIVMRDGVPTEVEGIVVPIAPSRQLDALAPNDAASPIDVFVGDPAAPGAFRGQFGGAKIQYRRSALVRKGRREEKAYLCGFRLPSQRRTGTPADDAGEVFLNLSLRVESQSEQAGRRNPPYAAVFHISDQTRRVIVRYGEIERYLAEHPDTGIPGSRGLTSGLRVMSVDLGLRTSAAISVFRVAHRDELTPDAHGRQPFFFPIHGMDHLVALHERSHLIRLPGETESKKVRSIREQRLDRLNRLRSQMASLRLLVRTGVLDEQKRDRNWERLQSSMERGGERMPSDWWDLFQAQVRYLAQHRDASGEAWGRMVQAAVRTLWRQLAKQVRDWRKEVRRNADKVKIRGIARDVPGGHSLAQLDYLERQYRFLRSWSAFSVQAGQVVRAERDSRFAVALREHIDNGKKDRLKKLADRILMEALGYVYVTDGRRAGQWQAVYPPCQLVLLEELSEYRFSNDRPPSENSQLMVWSHRGVLEELIHQAQVHDVLVGTIPAAFSSRFDARTGAPGIRCRRVPSIPLKDAPSIPIWLSHYLKQTERDAAALRPGELIPTGDGEFLVTPAGRGASGVRVVHADINAAHNLQRRLWENFDLSDIRVRCDRREGKDGTVVLIPRLTNQRVKERYSGVIFTSEDGVSFTVGDAKTRRRSSASQGEGDDLSDEEQELLAEADDARERSVVLFRDPSGFVNGGRWTAQRAFWGMVHNRIETLLAERFSVSGAAEKVRG

SEQ ID NO: 485 - protein, 1108 aa, Bacillus hisashii
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 486 - protein, 1364 aa, Unknown
  Uncultured organism
MPRDDLDLLTNLNSTAKGIRERGKTKEGTDKKKSGRKSSWPMDKAAWETAKTSDSSAHFLEKLKQHPDLKDAFGNLSSGGSKKLEYYKKLAGSAPWKESQSVILEKAARWKEAKQEREEKEQDSSEHGSKAAYRRLFDAGCLPMPEFAKYIDENQIEFGDLKLSDCGAEWKRGMWNQAGQRVRSHMGWQRRREKENAVYSLRKELFEKGGAIRRKKSEELTPEDILPGKAAPDQNDWQERPAYGNQMWFIGLRSYEENEMAKYAEEAGMGSRSAPRIRRGTIKGWSKLRERWLQILKRNPQATRDDLIGELNALRSQDPRAYGDARLFDWLSKTDQRFLWDGFDADGKILCGRDDRDCVSAFVAYNEEFADEPSSITLTETDERLHPVWPFFGESSAVPYEIEYDLETACPTAIRLPLLVGKENGGYAERQGTRLPLAEYADLASSFQLPTPVRLDVLVEIREVTRAGRKVTCPFSYFKQNGVWYVREGEIPSGESIQIKQTDRKIENGKIFISSKLRMAYRDDLMVSPATGDFGSIKILWERIELASHVDQKKLPETAPARSRVFVSFSCNVVERAPRKQLTRKPDAVVVTIPSGVDQGLVVVSTDVRTGKSKSSSAPPLPPGSRLWPADAVHGDPPLRILSVDLGHRHSAYAVWELGLQQKSWRAGVLKGSTQTPVYADCTGTGLLCLPGDGEDTPAEEESLRLRSRQIRRRLNLQNSILRVSRLLSLDKFEKTIFEQSDVRDRPNKKGLRIRRRCRTEKTPLSEAEVRKNCDKAAEILIRWADTDAMAKSLAATGNADISFWKYMAVKNPPLSAVVDVAPSTIVPDDGPDRETLKKKRQEEEEKFASSIYENRVKLAGALCSGYDADHRRPATGGLWHDLDRTLIREISYGDRGQKGNPRKLNNEGILRLLRRPPRARPDWREFHRTLNDANRIPKGRTLRGGLSMGRLNFLKEVGDFVKKWSCRPRWPGDRRHIPPGQLFDRQDAEHLEHLRDDRIKRLAHLIVAQALGFEPDIRRGLWKYVDGSTGEILWQHPETRRFFAEGAAGELREVSRPAEIDDDAAARPHTVSAPAHIVVFENLIRYRFQSDRPKTENAGLMQWAHRQIVHFTKQVASLYGLKVAMVYAAFSSKFCSRCGSPGARVSRFDPAWRNQEWFKRRTSNPRSKVDHSLKRASEDPTADETRPWVLIEGGKEFVCANAKCSAHDEPLNADENAAANIGLRFLRGVEDFRTKVNPAGALKGKLRFETGIHSFRPPVSGSPFWSPMAEPAQKKKIGAAAPGADVDEAGDADESGVVVLFRDPSGAFRNKQYWYEGKIFWSNVMMAVEAKIAGASVGAKPVAASWGQAQPQSGPGLAKPGGD

SEQ ID NO: 487 - protein, 1364 aa, Unknown
  Uncultured organism
MNRIYQGRVTKVEVPDGKDEKGNIKWKKLENWSDILWQHHMLFQDAVNYYTLALAAISGSAVGSDEKSIILREWAVQVQNIWEKAKKKATVFEGPQKRLTSILGLEQNASFDIAAKHILRTSEAKPEQRASALIRLLEEIDKKNHNVVCGERLPFFCPRNIQSKRSPTSKAVSSVQEQKRQEEVRRFHNMQPEEVVKNAVTLDISLFKSSPKIVFLEDPKKARAELLKQFDNACKKHKELVGIKKAFTESIDKHGSSLKVPAPGSKPSGLYPSAIVFKYFPVDITKTVFLKATEKLAMGKDREVTNDPIADARVNDKPHFDYFTNIALIREKEKNRAAWFEFDLAAFIEAIMSPHRFYQDTQKRKEAARKLEEKIKAIEGKGGQFKESDSEDDDVDSLPGFEGDTRIDLLRKLVTDTLGWLGESETPDNNEGKKTEYSISERTLRIFPDIQKQWSELAEKGETTEGKLLEVLKHEQTEHQSDFGSATLYQHLAKPEFHPIWLKSGTEEWHAENPLKAWLNYKELQYELTDKKRPIHFTPAHPVYSPRYFDFPKKSETEEKEVSKNTHSLTTSLASEHIKNSLQFTAGLIRKTNVGKKAIKARFSYSAPRLRRDCLRSENNENLYKAPWLQPMMRALGIDEEKADRQNFANTRITLMAKGLDDIQLGFPVEANSQELQKEVSNGISWKGQFNWGGIASLSALRWPHEKKPKNPPEQPWWGIDSFSCLAVDLGQRYAGAFARLDVSTIEKKGKSRFIGEACDKKWYAKVSRMGLLRLPGEDVKVWRDASKIDKENGFAFRKELFGEKGRSATPLEAEETAELIKLFGANEKDVMPDNWSKELSFPEQNDKLLIVARRAQAAVSRLHRWAWFFDEAKRSDDAIREILESDDTDLKQKVNKNEIEKVKETIISLLKVKQELLPTLLTRLANRVLPLRGRSWEWKKHHQKNDGFILDQTGKAMPNVLIRGQRGLSMDRIEQITELRKRFQALNQSLRRQIGKKAPAKRDDSIPDCCPDLLEKLDHMKEQRVNQTAHMILAEALGLKLAEPPKDKKELNETCDMHGAYAKVDNPVSFIVIEDLSRYRSSQGRSPRENSRLMKWCHRAVRDKLKEMCEVFFPLCERRKAGSAWVSLPPLLETPAAYSSRFCSRSGVAGFRAVEVIPGFELKYPWSWLKDKKDKAGNLAKEALNIRTVSEQLKAFNQDKPEKPRTLLVPIAGGPIFVPISEVGLSSFGLKPQVVQADINAAINLGLRAISDPRIWEIHPRLRTEKRDGRLFAREKRKYGEEKVEVQPSKNEKAKKVKDDRKPNYFADFSGKVDWGFGNIKNESGLTLVSGKALWWTINQLQWERCFDINKRHIEDWSNKQKQ

SEQ ID NO: 488 - protein, 1413 aa, Unknown
  Uncultured organism
MNRIYQGRVTKVEKLKNGKSPDDREELKDWQTALWRHHELFQDAVSYYTLALAAMAEGLPDKHPINVLRKRMEEAWEEFPRKTVTPAKNLRDSVRPWLGLSESASFGDALKKILPPAPENKEVRALAVALLAEKARTLKPQKTSASYWGRFCDDLKKKPNWDYSEEELARKTGSGDWVAGLWSEDALNKIDELAKSLKLSSLVKCVPDGQINPEGARNLVKEALDHLEGVSNGTKKEKNDPGPAKKTNNWLRQHASDVRNFIHKNKNQFSSLPNGRLITERARGGGININKTYAGVLFKAFPCPFTFDYVRAAVPEPKVKKVDQEKKSEQSATWTELEKRILRIGDDPIELARKNNKPIFKAFTALEKWSDQNSKSCWSDFDKCAFEEALKTLNQFNQKTEEREKRRSEAEAELKYMMDENPEWKPKKETEGDDVREVPILKGDPRYEKLVKLFGDLDEEGSEHATGKIYGPSRASLRGFGKLRNEWVDLFTKANDNPREQDLQKAVTGFQREHKLDMGYTAFFLKLCERDYWDIWRDDTEVEVKKIREKRWVKSVVYAAADTRELAEELERLQEPVRYTPAEPQFSRRLFMFSDIKGKQGAKHIREGLVEVSLAVKDQSGKYGTCRVRLHYSAPRLIRDHLSDGSSSMWLQPMMAALGLSSDARGCFTRDSKGNVKEPAVALMSDFVGRKRELRMLLNFPVDLDISKLEENIGKKARWEKQMNTAYEKNKLKQRFHLIWPGMELKETQEPGQFWWDNPTIQKEGMYCLAIDLSQRRAADYALLHAGVNRDSKTFVELGQAGGQSWFTKLCAAGSLRLPGEDTEVIREGKRQIELSGKKGRNATQSEYDQAIALAKQLLHNENSAELESAARDWLGDNAKRFSFPEQNDKLIDLYYGALSRYKTWLRWSWRLTEQHKELWDKTLDEIRKVPYFASWGELAGNGTNEATVQQLQKLIADAAVDLRNFLEKALLHIAYRALPLRENTWRWIENGKDGKGKPLHLLVSDGQSPAEIPWLRGQRGLSIARIEQLENFRRAVLSLNRLLRHEIGTKPEFGSSTCGESLPDPCPDLTDKIVRLKEERVNQTAHLIIAQSLGVRLKGHSLFTEEREKADMHGEHEVIPGRSPVDFVVLEDLSRYTTDKSRSRSENSRLMKWCHRKINEKVKLLAEPFGIPVIEVFASYSSKFDARTGAPGFRAVEVTSEDRPFWRKTIEKQSVAREVFDCLDNLVGKGLNGIHLVLPQNGGPLFIAAVKEDQPLPAIRQADINAAVNIGLRAIAGPSCYHAHPKVRLIKGESGTDKGKWLPRKGKEANKRENAQFGNVDLDLEVKFNRLDIDSDVLKGDNTNLFHDPLNIACYGFATIQNLQHPFLAHASAVFSRQKGAVARLQWEVCRAINSRRLEAWQKKAEKAAVKR

SEQ ID NO: 489 - protein, 747 aa, Unknown
  Bacterium in the Phycisphaerae family
MATKSYRARILTDSRLAAALDRTHVVFVESLKQMINTYLRMQNGKFGPDHKKLAQIMLSRSNTFAHGVMDQITRDQPTSTLDEEWTDLARRIHKTTGPLFLQAERFATVKNRAIHTKSRGKVIPSPETLAVPAKFWHQVCDSASAYIRSNRELMQQWRKDRAAWLKDKNEWQQKHPEFMQFYNGPYQNFLKLCDDDRITSQLAAEQQPTASKNNRPRKTGKRFARWHLWYKWLSENPEIIEWRNKASASDFKTVTDDVRKQIITKYPQQNKYITRLLDWLEDNNPELKTLENLRRTYVKKFDSFKRPPTLTLPSPYRHPYWFTMELDQFYKKADFENGTIQLLLIDEDDDGNWFFNWMPASLKPDPRLVPSWRAETFETEGRFPPYLGGKIGKKLSRPAPTDAERKAGIAGAKLMIKNNRSELLFTVFEQDCPPRVKWAKTKNRKCPADNAFSSDGKTRKPLRILSIDLGIRHIGAFALTQGTRNDSAWQTESLKKGIINSPSIPPLRQVRRHDYDLKRKRRRHGKPVKGQRSNANLQAHRTNMAQDRFKKGASAIVSLAREHSADLILFENLHSLKFSAFDERWMNRQLRDMNRRHIVELVSEQAPEFGITVKDDINPWMTSRICSNCNLPGFRFSMKKKNPYREKLPREKCTDFGYPVWEPGGHLFRCPHCDHRVNADINAAANLANKFFGLGYWNNGLKYDAETKTFTVHTDKKTPPLIFKPRPQFDLWADSVKTRKQLGPDPF

SEQ ID NO: 490 - protein, 743 aa, Unknown
  Member of the Planctomycetes phylum
MSVRSFQARVECDKQTMEHLWRTHKVFNERLPEIIKILFKMKRGECGQNDKQKSLYKSISQSILEANAQNADYLLNSVSIKGWKPGTAKKYRNASFTWADDAAKLSSQGIHVYDKKQVLGDLPGMMSQMVCRQSVEAISGHIELTKKWEKEHNEWLKEKEKWESEDEHKKYLDLREKFEQFEQSIGGKITKRRGRWHLYLKWLSDNPDFAAWRGNKAVINPLSEKAQIRINKAKPNKKNSVERDEFFKANPEMKALDNLHGYYERNFVRRRKTKKNPDGFDHKPTFTLPHPTIHPRWFVFNKPKTNPEGYRKLILPKKAGDLGSLEMRLLTGEKNKGNYPDDWISVKFKADPRLSLIRPVKGRRVVRKGKEQGQTKETDSYEFFDKHLKKWRPAKLSGVKLIFPDKTPKAAYLYFTCDIPDEPLTETAKKIQWLETGDVTKKGKKRKKKVLPHGLVSCAVDLSMRRGTTGFATLCRYENGKIHILRSRNLWVGYKEGKGCHPYRWTEGPDLGHIAKHKREIRILRSKRGKPVKGEESHIDLQKHIDYMGEDRFKKAARTIVNFALNTENAASKNGFYPRADVLLLENLEGLIPDAEKERGINRALAGWNRRHLVERVIEMAKDAGFKRRVFEIPPYGTSQVCSKCGALGRRYSIIRENNRREIRFGYVEKLFACPNCGYCANADHNASVNLNRRFLIEDSFKSYYDWKRLSEKKQKEEIETIESKLMDKLCAMHKISRGSISK

SEQ ID NO: 491 - protein, 1119 aa, Unknown
  Member of the Spirochaetes phylum
MSFTISYPFKLIIKNKDEAKALLDTHQYMNEGVKYYLEKLLMFRQEKIFIGEDETGKRIYIEETEYKKQIEEFYLIKKTELGRNLTLTLDEFKTLMRELYICLVSSSMENKKGFPNAQQASLNIFSPLFDAESKGYILKEENNNISLIHKDYGKILLKRLRDNNLIPIFTKFTDIKKITAKLSPTALDRMIFAQAIEKLLSYESWCKLMIKERFDKEVKIKELENKCENKQERDKIFEILEKYEEERQKTFEQDSGFAKKGKFYITGRMLKGFDEIKEKWLKEKDRSEQNLINILNKYQTDNSKLVGDRNLFEFIIKLENQCLWNGDIDYLKIKRDINKNQIWLDRPEMPRFTMPDFKKHPLWYRYEDPSNSNFRNYKIEVVKDENYITIPLITERNNEYFEENYTFNLAKLKKLSENITFIPKSKNKEFEFIDSNDEEEDKKDQKKSKQYIKYCDTAKNTSYGKSGGIRLYFNRNELENYKDGKKMDSYTVFTLSIRDYKSLFAKEKLQPQIFNTVDNKITSLKIQKKFGNEEQTNFLSYFTQNQITKKDWMDEKTFQNVKELNEGIRVLSVDLGQRFFAAVSCFEIMSEIDNNKLFFNLNDQNHKIIRINDKNYYAKHIYSKTIKLSGEDDDLYKERKINKNYKLSYQERKNKIGIFTRQINKLNQLLKIIRNDEIDKEKFKELIETTKRYVKNTYNDGIIDWNNVDNKILSYENKEDVINLHKELDKKLEIDFKEFIRECRKPIFRSGGLSMQRIDFLEKLNKLKRKWVARTQKSAESIVLTPKFGYKLKEHINELKDNRVKQGVNYILMTALGYIKDNEIKNDSKKKQKEDWVKKNRACQIILMEKLTEYTFAEDRPREENSKLRMWSHRQIFNFLQQKASLWGILVGDVFAPYTSKCLSDNNAPGIRCHQVTKKDLIDNSWFLKIVVKDDAFCDLIEINKENVKNKSIKINDILPLRGGELFASIKDGKLHIVQADINASRNIAKRFLSQINPFRVVLKKDKDETFHLKNEPNYLKNYYSILNFVPTNEELTFFKVEENKDIKPTKRIKMDKHEKESTDEGDDYSKNQIALFRDDSGIFFDKSLWVDGKIFWSVVKNKMTKLLRERNNKKNGSK

SEQ ID NO: 492 - protein, 1447 aa, Unknown
  Member of the phylum Verrucomicrobiaceae
MPLSRIYQGRTNSLIILTPTPQEPWDHKALARFDSPLWRHHALFQDAVNYYQLCLVALASSDGTRPLSKLHEQMKASWDEAKTDTEDSWRVRLARRLGIPAASLFEAALAKVLEGNEAPERARELAGELLLDKIEGDIQQAGRGYWPRFCDPKANPTYDYSATARASASGLTKLAAVIHAENVTEEALKQVAAEMDLSWTVKLQPDKNFVGAEARARLLEAAHHFIKVAESPPTKLAEVLARFPDGLALWQALPEKIAALPEETQVPRNRKASPDLTFATLLFQHFPSLFTAAVLGLSVGKPKSVKAPKVVEKVSARRKANAVTQAVVIEEPEIDFAELGDDPIKLARGERGFVFPAFTSLSFWAVPGPHVPVWKEFDIAAFKEALKTVNQFKLKTSERNALLAEAQRRLDYMDEKTHDWKTGDSDEPGHIPPRLKSDPNFTLIQALTQDEGVSNKATGDQHIPKGVYTGGLRGFYAIKKDWCELWERKADKSQGTPTEEELISIVTDYQRDHVYDVGDVGLFRALCEPRFWPLWQPLTDEQEAERIKAGRAKDMISAYRVWLELQEDVVRLAQPIRFTPAHAENSRRLFMFSDISGSHGAEFGSDGKSLEVSIAYDVDGKLQPVRAKLEFSAPRAARDELEGLSGGSESMRWFQPMMKALDCPEVEMPALEKCAVSLMPDVVKKGGGKWVRLLLNFPATLEPEGLIRHIGKQAMWYKQFNGTYKPRTQQLDTGLHLYWPGLEKAPEAEDAAAWWNREEIRAKGFSVLSVDLGQRDAGAWALLESRSDKAFSRNRQPFIELGEAGGKLWSTALLGLGMLRLPGEDARTGALDDQGKRAVEFHGKAGRNALEAEWQEAREMALLFGGEEAKSRLGPGFDHLSHSKQNEELLRILSRAQSRLARFHRWSCRIHEKPEATGDDVIDYGQVDELLTKTAEAMLENLKALYTNAGGILDSKSKQPLTLVGLRKKLEAQKVEPEKIAAVLKPHAEIIFQRLGTLIPELKQHLRVSLERLANRELPLRHREWVWNEAFEKLEQGNFKKEENPKWIRGQRGLSMARIEQIENLRKRFMSLRRQMSLIPGEQVKQGVEDKGQRQPEPCEDILNKLDRMKQQRVNQTAHLILAQALGLRLRPHLANDAEREEKDIHGEYELIPGRKPVDFIVMEDLSRYLSSQGRAPSENGRLMKWCHRAVLAKLKQMCEPFGIPVLEVPAAYSSRFCALTGVPGFRAVEVHDGNAEDFRWKRLIKKAEKDKSSKDAEAAAMLFDQLHDLNIEAREARKQDKKLPLRTLFAPVAGGPLFIPMVGGGPRQADMNAAINLGLRAIASPTCLRARPKIRAELKDGKHQAMLGNKLEKAAALTLEPPKEPTKELAAQKRTNFFLDEKFVGKFDTAHVTTSGKKLRLSGGMSLWKAIKDGAWQRVKKINDARIAKWKNNPPPEPDPDDEIQF

SEQ ID NO: 493 - protein, 1147 aa, Alicyclobacillus kakegawensis; identical to SEQ ID NO: 379

SEQ ID NO: 494 - protein, 1112 aa, Bacillus species; identical to SEQ ID NO: 380

SEQ ID NO: 495 - protein, 1489 aa, Desulfatirhabdium butyrativorans; identical to SEQ ID NO: 381

SEQ ID NO: 496 - protein, 1194 aa, Desulfonatronum thiodismutans; identical to SEQ ID NO: 382

SEQ ID NO: 497 - protein, 1326 aa, Unknown; identical to SEQ ID NO: 383
  Lentisphaeria bacterium

SEQ ID NO: 498 - protein, 1090 aa, Laceyella sediminis; identical to SEQ ID NO: 384

SEQ ID NO: 499 - protein, 1041 aa, Methylobacterium nodulans; identical to SEQ ID NO: 385

SEQ ID NO: 500 - protein, 1388 aa, Unknown; identical to SEQ ID NO: 386
  Member of the phylum Opitutaceae

SEQ ID NO: 501 - DNA, 162 bp, Unknown
  Member of the class Phycisphaerae
caacatgctcgctttgcgaaggctgacggcccgctctcatttggcattgccgggagccggagttttcggaagagagtgtcgacgactgctgatctccgcatccgcgtcctgttcgccaggccgggtcgggtgtacggatcatgctggcagcagtctacgccg

SEQ ID NO: 502 - RNA, 60 nt, Unknown; identical to SEQ ID NO: 2
  Member of the class Phycisphaerae

SEQ ID NO: 503 - RNA, 62 nt, Unknown; identical to SEQ ID NO: 3
  Member of the class Phycisphaerae

SEQ ID NO: 504 - RNA, 118 nt, Unknown; identical to SEQ ID NO: 4
  Member of the class Phycisphaerae

SEQ ID NO: 505 - RNA, 87 nt, Unknown; identical to SEQ ID NO: 5
  Member of the class Phycisphaerae

SEQ ID NO: 506 - RNA, 71 nt, Unknown; identical to SEQ ID NO: 6
  Member of the class Phycisphaerae

SEQ ID NO: 507 - RNA, 61 nt, Unknown; identical to SEQ ID NO: 7
  Member of the class Phycisphaerae

SEQ ID NO: 508 - RNA, 87 nt, Unknown; identical to SEQ ID NO: 8
  Member of the class Phycisphaerae

SEQ ID NO: 509 - RNA, 84 nt, Unknown; identical to SEQ ID NO: 9
  Member of the class Phycisphaerae

SEQ ID NO: 510 - RNA, 84 nt, Unknown; identical to SEQ ID NO: 9
  Member of the class Phycisphaerae

SEQ ID NO: 511 - RNA, 83 nt, Unknown
  Member of the class Phycisphaerae
uccgcauccgcguccuguucgccaggccgggucggguguacggaucaugcuggcagcagucuacgccgagaacauucgcuuuu

SEQ ID NO: 512 - DNA, 32 bp, Unknown
  Member of the class Phycisphaerae
ggcgcaacccgcacacaaccgcgaatggacac

SEQ ID NO: 513 - DNA, 14 bp, Unknown
  Member of the class Phycisphaerae
ccgcgaatggacac

SEQ ID NO: 514 - RNA, 20 nt, Artificial Sequence
  Synthetic Oligonucleotide
uggguuggguuggguuggga

SEQ ID NO: 515 - RNA, 23 nt, Artificial Sequence
  Synthetic Oligonucleotide
uggguuuggguuuggguuuggga

SEQ ID NO: 516 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 517 - protein, 1147 aa, Alicyclobacillus kakegawensis; identical to SEQ ID NO: 379

SEQ ID NO: 518 - protein, 1146 aa, Alicyclobacillus macrosporangiidus
MNVAVKSIKVKLMLGHLPEIREGLWHLHEAVNLGVRYYTEWLALLRQGNLYRRGKDGAQECYMTAEQCRQELLVRLRDRQKRNGHTGDPGTDEELLGVARRLYELLVPQSVGKKGQAQMLASGFLSPLADPKSEGGKGTSKSGRKPAWMGMKEAGDSRWVEAKARYEANKAKDPTKQVIASLEMYGLRPLFDVFTETYKTIRWMPLGKHQGVRAWDRDMFQQSLERLMSWESWNERVGAEFARLVDRRDRFREKHFTGQEHLVALAQRLEQEMKEASPGFESKSSQAHRITKRALRGADGIIDDWLKLSEGEPVDRFDEILRKRQAQNPRRFGSHDLFLKLAEPVFQPLWREDPSFLSRWASYNEVLNKLEDAKQFATFTLPSPCSNPVWARFENAEGTNIFKYDFLFDHFGKGRHGVRFQRMIVMRDGVPTEVEGIVVPIAPSRQLDALAPNDAASPIDVFVGDPAAPGAFRGQFGGAKIQYRRSALVRKGRREEKAYLCGFRLPSQRRTGTPADDAGEVFLNLSLRVESQSEQAGRRNPPYAAVFHISDQTRRVIVRYGEIERYLAEHPDTGIPGSRGLTSGLRVMSVDLGLRTSAAISVFRVAHRDELTPDAHGRQPFFFPIHGMDHLVALHERSHLIRLPGETESKKVRSIREQRLDRLNRLRSQMASLRLLVRTGVLDEQKRDRNWERLQSSMERGGERMPSDWWDLFQAQVRYLAQHRDASGEAWGRMVQAAVRTLWRQLAKQVRDWRKEVRRNADKVKIRGIARDVPGGHSLAQLDYLERQYRFLRSWSAFSVQAGQVVRAERDSRFAVALREHIDNGKKDRLKKLADRILMEALGYVYVTDGRRAGQWQAVYPPCQLVLLEELSEYRFSNDRPPSENSQLMVWSHRGVLEELIHQAQVHDVLVGTIPAAFSSRFDARTGAPGIRCRRVPSIPLKDAPSIPIWLSHYLKQTERDAAALRPGELIPTGDGEFLVTPAGRGASGVRVVHADINAAHNLQRRLWENFDLSDIRVRCDRREGKDGTVVLIPRLTNQRVKERYSGVIFTSEDGVSFTVGDAKTRRRSSASQGEGDDLSDEEQELLAEADDARERSVVLFRDPSGFVNGGRWTAQRAFWGMVHNRIETLLAERFSVSGAAEKVRG

SEQ ID NO: 519 - protein, 1108 aa, Bacillus hisashii; identical to SEQ ID NO: 485

SEQ ID NO: 520 - protein, 1108 aa, Bacillus species; identical to SEQ ID NO: 387

SEQ ID NO: 521 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 522 - protein, 1112 aa, Bacillus species; identical to SEQ ID NO: 380

SEQ ID NO: 523 - protein, 1364 aa, Unknown; identical to SEQ ID NO: 486
  Member of the candidate phylum Lindowbacteriae

SEQ ID NO: 524 - protein, 1489 aa, Desulfatirhabdium butyrativorans; identical to SEQ ID NO: 381

SEQ ID NO: 525 - protein, 1194 aa, Desulfonatronum thiodismutan; identical to SEQ ID NO: 382

SEQ ID NO: 526 - protein, 1364 aa, Unknown; identical to SEQ ID NO: 487
  Member of the phylum Elusimicrobia

SEQ ID NO: 527 - protein, 1326 aa, Unknown; identical to SEQ ID NO: 383
  Member of the phylum Lentisphaeria

SEQ ID NO: 528 - protein, 1090 aa, Laceyella sediminis; identical to SEQ ID NO: 384

SEQ ID NO: 529 - protein, 1041 aa, Methylobacterium nodulans; identical to SEQ ID NO: 385

SEQ ID NO: 530 - protein, 1413 aa, Unknown; identical to SEQ ID NO: 488
  Member of the candidate phylum Omnitrophica

SEQ ID NO: 531 - protein, 1388 aa, Unknown; identical to SEQ ID NO: 386
  Member of the family Opitutaceae

SEQ ID NO: 532 - protein, 747 aa, Unknown; identical to SEQ ID NO: 489
  Member of the class Phycisphaerae

SEQ ID NO: 533 - protein, 743 aa, Unknown; identical to SEQ ID NO: 490
  Member of the phylum Planktomycetes

SEQ ID NO: 534 - protein, 1119 aa, Unknown; identical to SEQ ID NO: 491
  Member of the Spirochaetes

SEQ ID NO: 535 - protein, 1447 aa, Unknown; identical to SEQ ID NO: 492
  Member of the phylum Verrucomicrobiaceae

SEQ ID NO: 536 - RNA, 25 nt, Artificial Sequence
  Synthetic Oligonucleotide
uagaugaauuaaaugugauuagcac

SEQ ID NO: 537 - RNA, 80 nt, Artificial Sequence
  Synthetic Oligonucleotide
uuugccuaaagggcaaagaauacugugcgugugcuaaggauggaaaaaauccauucaaccacaggauuacauuauuuauc

SEQ ID NO: 538 - RNA, 105 nt, Artificial Sequence
  Synthetic Oligonucleotide
uuugccuaaagggcaaagaauacugugcgugugcuaaggauggaaaaaauccauucaaccacaggauuacauuauuuaucaaaagaugaauaaugugauuagcac

SEQ ID NO: 539 - RNA, 25 nt, Artificial Sequence
  Synthetic Oligonucleotide
agcgagcggucugagaaguggcacu

SEQ ID NO: 540 - RNA, 89 nt, Artificial Sequence
  Synthetic Oligonucleotide
gucgucuauaggacggcgaggacaacgggaagugccaaugugcucuuuccaagagcaaacaccccguuggcuucaagaugaccgcucgc

SEQ ID NO: 541 - RNA, 113 nt, Artificial Sequence; identical to SEQ ID NO: 85
  Synthetic Oligonucleotide

SEQ ID NO: 542 - RNA, 23 nt, Artificial Sequence
  Synthetic Oligonucleotide
gcagaaauaaugaugauuggcac

SEQ ID NO: 543 - RNA, 78 nt, Artificial Sequence
  Synthetic Oligonucleotide
gaccuauagggucaaugaaucugugcgugugccauaaguaauuaaaaauuacccaccacaggauuaucuuauuucugc

SEQ ID NO: 544 - RNA, 104 nt, Artificial Sequence; identical to SEQ ID NO: 97
  Synthetic Oligonucleotide

SEQ ID NO: 545 - RNA, 194 nt, Artificial Sequence
  Synthetic Oligonucleotide
ucagccaacaugcucgcuuugcgaaggcugacggcccgcucucauuuggcauugccgggagccggaguuuucggaagagagugucgacgacugcugaucuccgcauccgcguccuguucgccaggccgggucggguguacggaucaugcuggcagcagucuacgccgagaacauucgcuaccgcgaauggacac

SEQ ID NO: 546 - RNA, 194 nt, Artificial Sequence
  Synthetic Oligonucleotide
guggaguaaggucggaguaacgaccgaacguuuagcgugcuauaggccgcugaaugccacacagcgauguguuuugagugucaauagcugcugacccaaaggccaaaagccgaguagggcuugacugaugcgguuuauaucgcacauaggcggcaguaacacauaucgcgucaaucaaauuuauugauggacac

SEQ ID NO: 547 - RNA, 21 nt, Artificial Sequence
  Synthetic Oligonucleotide
gggcgaucugagaaguggcac

SEQ ID NO: 548 - RNA, 29 nt, Artificial Sequence
  Synthetic Oligonucleotide
cguugagcgggcgaucugagaaguggcac

SEQ ID NO: 549 - RNA, 36 nt, Artificial Sequence
  Synthetic Oligonucleotide
gucggaucguugagcgggcgaucugagaaguggcac

SEQ ID NO: 550 - DNA, 41 bp, Artificial Sequence
  Synthetic Oligonucleotide
cgatctgagaagtggcacgagaagtcatttaataaggccac

SEQ ID NO: 551 - RNA, 32 nt, Artificial Sequence
  Synthetic Oligonucleotide
ccgaucuauaggacggcagauucaacgggaug

SEQ ID NO: 552 - RNA, 38 nt, Artificial Sequence
  Synthetic Oligonucleotide
ccgaucuauaggacggcagauucaacgggaugugccaa

SEQ ID NO: 553 - RNA, 61 nt, Artificial Sequence
  Synthetic Oligonucleotide
ccgaucuauaggacggcagauucaacgggaugugccaaugcacucuuuccaggagugaaca

SEQ ID NO: 554 - RNA, 97 nt, Artificial Sequence
  Synthetic Oligonucleotide
ccgaucuauaggacggcagauucaacgggaugugccaaugcacucuuuccaggagugaacaccccguuggcuucaacaugaucgcccgcucaacggu

SEQ ID NO: 555 - RNA, 59 nt, Artificial Sequence
  Synthetic Oligonucleotide
ugccaaugcacucuuuccaggagugaacaccccguuggcuucaacaugaucgcccgcuc

SEQ ID NO: 556 - RNA, 139 nt, Artificial Sequence
  Synthetic Oligonucleotide
gccgaucuauaggacggcagauucaacgggaugugccaaugcacucuuuccaggagugaacaccccguuggcuucaacaugaucgcccgcucaacggucccuagucggaucguugagcgggcgaucugagaaguggcac

SEQ ID NO: 557 - RNA, 128 nt, Artificial Sequence
  Synthetic Oligonucleotide
gccgaucuauaggacggcagauucaacgggaugugccaaugcacucuuuccaggagugaacaccccguuggcuucaacaugaucgcccgcucaacgcuacguugagcgggcgaucugagaaguggcac

SEQ ID NO: 558 - RNA, 112 nt, Artificial Sequence
  Synthetic Oligonucleotide
gccgaucuauaggacggcagauucaacgggaugugccaaugcacucuuuccaggagugaacaccccguuggcuucaacaugaucgccccuagggcgaucugagaaguggcac

SEQ ID NO: 559 - RNA, 20 nt, Artificial Sequence
  Synthetic Oligonucleotide
augauacgaggcauuagcac

SEQ ID NO: 560 - RNA, 36 nt, Artificial Sequence
  Synthetic Oligonucleotide
guccaagaaaaaagaaaugauacgaggcauuagcac

SEQ ID NO: 561 - RNA, 89 nt, Artificial Sequence; identical to SEQ ID NO: 38
  Synthetic Oligonucleotide

SEQ ID NO: 562 - RNA, 99 nt, Artificial Sequence
  Synthetic Oligonucleotide
gagguucugucuuuuggucaggacaaccgucuagcuauaagugcugcagggugugagaaacuccuauugcuggacgaugucucuacgaggcauuagcac

SEQ ID NO: 563 - RNA, 106 nt, Artificial Sequence; identical to SEQ ID NO: 40
  Synthetic Oligonucleotide

SEQ ID NO: 564 - RNA, 102 nt, Artificial Sequence; identical to SEQ ID NO: 41
  Synthetic Oligonucleotide

SEQ ID NO: 565 - DNA, 120 bp, Artificial Sequence
  Synthetic Oligonucleotide
  misc_feature (98)..(120): n = any nucleotide
gttctgtcttttggtcaggacaaccgtctagctataagtgctgcagggtgtgagaaactcctattgctggacgacgcctcttacgaggcgttagcacnnnnnnnnnnnnnnnnnnnnnnn

SEQ ID NO: 566 - protein, 1173 aa, Artificial Sequence
  Synthetic Peptide
MAPKKKRKVGIHGVPAAAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVELKRPAATKKAGQAKKKKGSYPYDVPDYAYPYDVPDYAYPYDVPDYA

SEQ ID NO: 567 - RNA, 127 nt, Artificial Sequence
  Synthetic Oligonucleotide
  misc_feature (105)..(127): n = any nucleotide
gaccuauagggucaaugaaucugugcgugugccauaaguaauuaaaaauuacccaccacaggauuaucuuauuucugcaaaagcagaaauaagaugauuggcacnnnnnnnnnnnnnnnnnnnnnnn

SEQ ID NO: 568 - RNA, 130 nt, Artificial Sequence
  Synthetic Oligonucleotide
  misc_feature (108)..(130): n = any nucleotide
ggugaccuauagggucaaugaaucugugcgugugccauaaguaauuaaaaauuacccaccacaggauuaucuuauuucugcaaaagcagaaauaagaugauuggcacnnnnnnnnnnnnnnnnnnnnnnn

SEQ ID NO: 569 - RNA, 124 nt, Artificial Sequence
  Synthetic Oligonucleotide
  misc_feature (102)..(124): n = any nucleotide
cuauagggucaaugaaucugugcgugugccauaaguaauuaaaaauuacccaccacaggauuaucuuauuucugcaaaagcagaaauaagaugauuggcacnnnnnnnnnnnnnnnnnnnnnnn

SEQ ID NO: 570 - RNA, 111 nt, Artificial Sequence
  Synthetic Oligonucleotide
  misc_feature (89)..(111): n = any nucleotide
gaccuauagggucaaugaaucugugcgugugccauaaguaauuaaaaauuacccaccacaggaucaucuuaaaaaagaugauuggcacnnnnnnnnnnnnnnnnnnnnnnn

SEQ ID NO: 571 - RNA, 121 nt, Artificial Sequence
  Synthetic Oligonucleotide
  misc_feature (99)..(121): n = any nucleotide
gaccuauagggucaaugaaucugugcgugugccauaaguaauuaaaaauuacccaccacaggaucaucuuauuucaaaagaaauaagaugauuggcacnnnnnnnnnnnnnnnnnnnnnnn

SEQ ID NO: 572 - RNA, 111 nt, Artificial Sequence
  Synthetic Oligonucleotide
  misc_feature (89)..(111): n = any nucleotide
gaccuauagggucaaugaaucugugcgugugccauaaguaauuaaaaauuacccaccacaggagcaccugaaaacaggugcuuggcacnnnnnnnnnnnnnnnnnnnnnnn

SEQ ID NO: 573 - DNA, 23 bp, Artificial Sequence
  Synthetic Oligonucleotide
cccttcagctaaaataaaggagg

SEQ ID NO: 574 - DNA, 23 bp, Artificial Sequence
  Synthetic Oligonucleotide
ggctcagcaggcacctgcctcag

SEQ ID NO: 575 - DNA, 23 bp, Artificial Sequence
  Synthetic Oligonucleotide
acgtactgatgttaacagctgac

SEQ ID NO: 576 - DNA, 23 bp, Artificial Sequence
  Synthetic Oligonucleotide
gggactggagttgcttcatgtac

SEQ ID NO: 577 - DNA, 23 bp, Artificial Sequence
  Synthetic Oligonucleotide
ctgacctcccaaacagctacata

SEQ ID NO: 578 - DNA, 23 bp, Artificial Sequence
  Synthetic Oligonucleotide
ttcatggagaaaatattcagaat

SEQ ID NO: 579 - DNA, 23 bp, Artificial Sequence
  Synthetic Oligonucleotide
tctccatgaaaaatactggggtc

SEQ ID NO: 580 - DNA, 9041 bp, Bacillus species
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccggatccgccgtgaagtccatcaaagtgaagctgcggctgagcgagtgccccgatattctggctggaatgtggcagctgcacagagccacaaatgccggcgtgcggtactacacagaatgggtgtccctgatgcggcaagagatcctgtacagcagaggccctgatggcggccagcagtgttatatgaccgccgaggattgccagagagagctgctgcggagactgcggaatagacagctgcataacggccggcaggatcagcctggaacagatgctgatctgctggccatcagcagacggctgtacgagattctggtgctgcagagcatcggcaaaagaggcgacgcccagcagattgccagcagctttctgagccctctggtggaccccaacagcaaaggtggaagaggcgaggccaagagcggaagaaaacctgcctggcagaagatgcgcgaccagggcgatcctagatgggttgccgctagagagaagtacgagcagcggaaggccgtggatcccagcaaagagattctgaacagcctggacgccctgggcctcagacctctgtttgccgtgttcaccgagacatacagatccggcgtggactggaagcctctgggcaaatctcagggcgtcagaacctgggacagagacatgtttcagcaggccctggaacggctgatgagctgggagagctggaatcggagagtgggcgaagagtacgccagactgttccagcagaaaatgaagttcgagcaagagcacttcgccgagcagagccacctggtcaaactggctagagccctggaagccgatatgagagccgcctctcagggcttcgaggccaaaagaggaacagcccaccagatcaccagaagggcactgagaggggccgacagagtgttcgagatctggaagtctatccccgaggaagccctgttcagccagtacgacgaagtgatcagacaggtgcaggccgagaagcggagagatttcggcagccatgacctgttcgccaagctggccgagcctaagtatcagcccctttggagagccgacgagacattcctgaccagatacgccctgtacaacggcgtgctgcgcgatctggaaaaggccagacagttcgccaccttcacactgcctgatgcctgcgtgaaccccatctggaccagattcgagtctagccagggcagcaacctgcacaaatacgagtttctgttcgaccacctcggacctggcagacacgccgtcagatttcagagactgctggtggtggaaagcgagggcgccaaagaaagggatagcgtggtggtgcctgtggctccttctggccaactggataagctggtgctgagggaagaagagaagtccagcgtcgccctgcatctgcacgataccgctagacccgatggcttcatggctgaatgggctggcgccaaactgcagtacgagagaagcaccctggccagaaaagccagacgggacaagcagggcatgagaagctggcggagacagccctccatgctgatgtctgccgctcagatgctggaagatgccaaacaggctggcgacgtgtacctgaacatcagcgtgcgcgtgaagtctcccagtgaagtgcgaggacagaggcggcctccttacgccgctctgtttagaatcgacgacaagcagcggagagtgaccgtgaactacaacaagctgagcgcctacctggaagaacaccccgataagcagatccctggcgctcctggactgctgtctggactgagagtgatgtccgtggacctgggcctgagaacaagcgccagcatctccgtgttcagagtggccaagaaagaagaggtggaagccctcggagatggccggcctcctcactactatcctatccacggcaccgatgacctggtggccgtgcacgaaagatcccacctgattcagatgcccggcgaaaccgagacaaagcagctgcggaagctgagagaagaacggcaggccgtgctgaggccactgtttgctcaactggcactgctgagactgctcgtcagatgtggcgccgctgacgagagaatcagaaccagatcctggcagcggctgaccaagcagggaagagagttcaccaagagactgacccctagctggcgcgaggctctggaactggaactgacaagactcgaggcctactgcggcagagtgcccgatgatgagtggtccagaatcgtggacagaaccgtgattgccctgtggcggagaatgggcaagcaagtgcgcgattggcggaagcaagtgaagtccggggccaaagtgaaagtgaagggctaccagctggatgtcgtcggcggaaattctctggcccagatcgactatctggaacagcagtacaagttcctgcggcgttggagcttcttcgccagagcttctggcctggtcgtgcgggccgatagagaaagccattttgccgtggctctgagacagcacatcgagaacgccaagcgggacagactgaagaaactggccgaccggatcctgatggaagcactgggctatgtgtacgaggccagcggacctagagaaggccagtggacagctcagcaccctccttgccagctgatcattctcgaggaactgtccgcctaccggttcagcgacgatagacctcctagcgagaacagcaaactgatggcctggggccacagaggcatcctcgaagaactggtcaaccaggctcaggtgcacgatgtgctcgtgggcacagtgtacgccgccttcagcagcagattcgacgctagaacaggtgctcccggcgtcagatgcagaagagtgcctgccagatttgtgggcgccaccgtggatgattctctgccactgtggctgaccgagttcctggacaagcaccggctggataagaacctgctgcggcccgacgatgtgatcccaacaggcgaaggcgaattcctggtgtccccttgtggcgaagaggctgccagagttagacaggttcacgccgacatcaacgctgcccagaacctgcagagaaggctgtggcagaacttcgacatcaccgagctgaggctgagatgcgacgtgaagatgggcggagagggaacagtgctggtgcccagagtgaacaacgccagagccaagcagctgttcggcaagaaggtgctggtttcccaggacggcgtgaccttcttcgagagatctcagacaggcggcaagccccacagcgagaagcagaccgatctgaccgacaaagaactcgagctgatcgccgaggccgatgaggccagagctaaaagcgtggtgctgttcagggatcctagcggccacattggcaaaggccactggatccggcagcgcgagttttggagtctggtcaagcagaggatcgagagccacaccgccgagcggattagagttagaggcgtgggaagctccctggacggatccaaaaggccggcggccacgaaaaaggccggccaggcaaaaaagaaaaagggatcttacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 581 - DNA, 8924 bp, Bacillus hisashii
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccggatccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgggatccaaaaggccggcggccacgaaaaaggccggccaggcaaaaaagaaaaagggatcttacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 582 - DNA, 9692 bp, Unknown
  Member of the phylum Elusimicrobia
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccggatccaaccggatctaccagggcagagtgaccaaggtggaagtgcccgatggcaaggacgagaagggcaacatcaagtggaagaagctggaaaattggagcgacatcctgtggcagcaccacatgctgttccaggacgccgtgaactactacacactggccctggccgccatctctggatctgctgttggcagcgacgagaagtccatcatcctgagagaatgggccgtgcaggtccagaacatctgggagaaagccaagaaaaaggccaccgtgttcgagggcccacagaagagactgaccagcatcctgggccttgagcagaacgccagcttcgacattgccgccaagcacatcctgaggacctctgaggccaagcctgagcagagagctagcgccctgatcagactgctggaagagatcgacaagaaaaaccacaacgtcgtgtgcggcgagcggctgccttttttctgccctcggaacatccagagcaagcggagccctacaagcaaggccgtgtctagcgtgcaagagcagaaacggcaagaggaagtgcggcggttccacaacatgcagcctgaggaagtggtcaagaacgccgtgacactggacatcagcctgttcaagagcagccccaagatcgtgttcctggaagatcccaagaaggccagagccgagctgctgaagcagttcgacaacgcctgcaagaaacacaaagaactcgtgggcatcaagaaagccttcaccgagtccatcgacaagcacggctctagcctgaaggtgccagctcctggctctaagcctagcggcctgtatcctagcgccatcgtgttcaagtacttccccgtggatattaccaagaccgtgtttctgaaggccacagagaagctggccatgggcaaagaccgggaagtgaccaacgatcctatcgccgacgccagagtgaacgacaagccccacttcgactacttcaccaacattgccctgatccgcgagaaagagaagaacagagccgcttggtttgagttcgatctggccgcctttatcgaggccatcatgagccctcacagattctaccaggacacccagaagcggaaagaggccgccagaaagctggaagaaaagatcaaggccatcgaaggcaaaggcgggcagttcaaagagagcgacagcgaggacgacgacgtggactctctgcctggatttgagggcgacaccagaatcgacctgctgcggaagctggtcaccgatacacttggatggctgggcgagagcgagacacccgataacaacgagggcaaaaagaccgagtacagcatcagcgagcggaccctgagaatcttccccgacatccagaagcagtggagcgagctggccgagaaaggcgagacaacagagggaaagctgctcgaagtgctgaaacacgagcagaccgagcaccagagcgatttcggaagcgccacactgtatcagcacctggccaagccagagtttcaccccatctggctgaagtccggcaccgaggaatggcacgccgagaatcctctgaaagcctggctgaactacaaagagctgcagtacgagctgaccgacaagaagcggcccatccactttacccctgctcaccctgtgtacagccccagatacttcgacttccccaagaagtccgaaaccgaagagaaagaggtgtccaagaacacccacagcctgaccacaagcctggccagcgagcacatcaagaactccctgcagtttacagccgggctgatcagaaagaccaacgtgggcaagaaggctatcaaggcccggttcagctacagcgcccctagactgagaagggactgcctgagaagcgagaacaacgagaacctgtacaaggccccttggctccagcctatgatgagagccctgggcatcgacgaggaaaaggccgacagacagaacttcgccaacaccaggatcaccctgatggccaaaggcctggacgacattcagctgggctttcccgtggaagccaacagccaagaactgcagaaagaagtgtctaacggcatcagctggaagggccagttcaactggggaggaatcgcctctctgtctgccctgagatggccccacgagaagaagcccaagaatcctcctgagcagccttggtggggcatcgatagctttagctgcctggccgtggatctgggccagagatatgctggcgccttcgccagactggacgtgtccaccattgagaaaaagggcaagagccggttcatcggcgaggcctgcgacaaaaagtggtacgccaaggtgtcccggatgggcctgttgagacttcctggcgaggacgtgaaagtgtggcgggatgccagcaagattgacaaagagaacggcttcgccttccggaaagagctgttcggcgagaagggaagatccgccacacctctggaagccgaggaaaccgccgagctgatcaagctgtttggagccaacgagaaggacgtgatgcccgacaactggtctaaagagctgagcttccccgagcagaatgacaagctgctgatcgtggctcggagagcccaggctgctgttagcagactgcatagatgggcatggttcttcgacgaggccaagagatccgacgacgccatcagagagattctggaaagcgacgacaccgacctgaagcagaaagtgaacaagaacgagatcgagaaagtcaaagagacaatcatctccctgctgaaagtcaagcaagagctgctgcccacactgctgaccagactggccaatagagtgctgcccctgagaggcagatcctgggagtggaaaaagcaccaccagaagaacgacggcttcatcctggaccagaccggcaaggccatgcctaacgtgctgattagaggacagcggggcctgagcatggaccggatcgagcagattaccgagctgagaaagcggtttcaggccctgaaccagagcctgcggagacagatcggaaagaaggcccctgccaagcgggacgactctatccctgattgctgccccgatctgctggaaaaactggaccacatgaaggaacagcgcgtgaaccagacagcccacatgattctggccgaggcactgggactgaaactggccgagcctcctaaggacaagaaagaactgaacgagacatgcgacatgcacggcgcctacgccaaagtggacaaccccgtgtccttcatcgtgatcgaggacctgagccggtacagaagcagccaaggcagaagccccagagaaaacagccgactgatgaagtggtgccacagggccgtcagagacaagctgaaagaaatgtgcgaggtgttcttcccactgtgcgagagaagaaaggccggctctgcttgggtttccctgcctcctctgcttgaaacaccagccgcctacagcagcagattctgcagcagatctggcgtggccggcttcagagccgtggaagtgattcctggcttcgagctgaagtacccctggtcttggctgaaggataagaaggacaaggccggcaatctggccaaagaagccctgaacatccggaccgtgtctgagcagctgaaggcctttaaccaggacaagcccgagaagcccaggacactgctggtgcctattgccggcggacctatcttcgtgcccatctctgaagtgggcctgtccagcttcggactgaagcctcaggttgtgcaggccgacatcaacgccgccatcaatctgggactcagagccatcagcgaccctcggatttgggagattcaccccagactgcggaccgagaagagagatggcagactgttcgccagagagaaacggaagtacggcgaagagaaggtcgaggtgcagcccagcaagaatgagaaggccaaaaaagtgaaggacgaccggaagcctaactacttcgccgatttcagcggcaaggtggactggggctttggcaacattaagaacgagtccggcctgacactggtgtctggcaaagcactgtggtggaccatcaaccagctgcagtgggagagatgctttgacatcaacaagcggcacatcgaggactggtccaacaagcagaagcaaggatccaaaaggccggcggccacgaaaaaggccggccaggcaaaaaagaaaaagggatcttacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 583 - DNA, 9041 bp, Alicyclobacillus kakegawensis; identical to SEQ ID NO: 580

SEQ ID NO: 584 - DNA, 7826 bp, Unknown
  Member of the class Phycisphaerae
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccgccaccaagagctacagagccagaatcctgaccgacagcagactggccgctgctctggatagaacccacgtggtgtttgtggaaagcctgaagcagatgatcaacacctacctgcggatgcagaacggcaagttcggccccgaccacaagaaactggcccagatcatgctgagccggtccaacacatttgcccacggcgtgatggaccagatcaccagagatcagcccaccagcacactggacgaggaatggaccgacctggccagaagaatccacaagacaaccggacctctgttcctgcaagccgagagattcgccaccgtgaagaacagagccatccacaccaagtccagaggcaaagtgatcccatctcctgagacactggccgtgcctgccaagttctggcaccaagtgtgcgatagcgccagcgcctacatcagatccaaccgcgaactgatgcagcagtggcggaaagatagagccgcctggctgaaggacaagaacgagtggcagcagaaacaccccgagttcatgcagttctacaacggcccctaccagaacttcctgaagctgtgcgacgacgacagaatcacctctcagctggctgccgagcagcagcctacagccagcaagaacaacagacccagaaagaccggcaagcgcttcgccagatggcacctgtggtacaagtggctgagcgagaaccccgagatcatcgaatggcggaacaaggcctccgccagcgactttaagaccgtgaccgatgacgtgcggaagcagatcattaccaagtatccccagcagaacaagtacatcacccggctgctggactggctggaagataacaaccccgagctgaaaaccctggaaaacctgcggcggacctacgtgaagaagttcgacagcttcaagcggcctcctacactgaccctgccatctccatacagacacccctactggttcaccatggaactggaccagttttacaagaaggccgacttcgagaacggcaccatccagctgctgctgatcgacgaggacgacgacggcaactggttcttcaactggatgcccgcctctctgaagcccgatcctagactggtgccttcttggagagccgaaaccttcgagacagagggcagattccctccttacctcggcggcaagatcggcaagaagctgagcagacctgctcctaccgacgccgagagaaaggctggaattgccggcgctaagctgatgattaagaacaatcggagcgagctgctgttcaccgtgttcgagcaggactgccctcctagagtgaagtgggccaagaccaagaaccggaagtgccctgccgacaacgcctttagctccgacggcaagaccagaaagcccctgagaatcctgtccatcgacctgggcatcagacacatcggcgccttcgctctgacacagggcaccagaaatgatagcgcctggcagaccgagagcctgaagaagggcatcatcaacagccctagcatccctccactgcggcaagtgcggagacacgactacgacctgaagcggaaaagacggcggcacggcaagcctgtgaagggccagagaagcaacgccaatctgcaggcccacaggaccaacatggcccaggacagattcaagaagggcgcctctgccatcgtgtcactggccagagagcatagcgccgacctgatcctgttcgagaacctgcacagcctgaagttcagcgccttcgacgagcggtggatgaacagacagctgcgggacatgaaccggcggcacatcgtggaactggtgtctgaacaggcccctgagttcggcatcacagtgaaggacgacatcaacccctggatgaccagccggatctgcagcaactgtaacctgcctggcttcaggttcagcatgaagaagaagaacccctaccgcgagaagctgcccagagagaagtgcaccgatttcggctaccctgtgtgggaacctggcggccacctgtttagatgccctcactgcgaccacagagtgaacgccgacattaacgccgctgccaacctggccaacaagttctttggcctcggctactggaacaacggcctgaagtacgatgccgagacaaagaccttcaccgtgcacaccgacaagaaaaccccacctctgatcttcaagcccagacctcagttcgatctgtgggccgacagcgtgaaaacacggaagcagcttggccccgatcctttcaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 585 - DNA, 7814 bp, Unknown
  Member of the phylum Planctomycetes
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccagcgtgcggagctttcaggccagagtggaatgcgacaagcagaccatggaacacctgtggcggacccacaaggtgttcaacgagagactgcccgagatcatcaagatcctgttcaagatgaagcggggcgagtgcggccagaacgataagcagaagtccctgtacaagagcatcagccagagcatcctggaagccaacgctcagaacgccgactacctgctgaacagcgtgtccatcaaaggctggaagcctggcaccgccaagaagtacagaaacgccagcttcacctgggccgacgatgccgctaaactgtctagccagggcatccacgtgtacgacaagaaacaggtgctgggcgacctgcctggcatgatgtctcagatggtctgcaggcagagcgtggaagccatctctggacacatcgagctgaccaagaagtgggagaaagaacacaacgagtggctgaaagaaaaagagaaatgggagtccgaggacgagcacaagaagtatctggacctgcgcgagaagttcgagcagtttgagcagagcatcggcggcaagatcaccaagagaagaggccggtggcacctgtacctgaagtggctgagcgacaaccctgattttgccgcctggcggggaaacaaggccgtgatcaatcctctgagcgagaaggcccagatcaggatcaacaaggccaagccgaacaagaagaacagcgtcgagcgggacgagttcttcaaggccaatcctgagatgaaggccctggacaacctgcacggctactacgagcggaatttcgtgcggcggagaaagacaaagaagaaccccgacggcttcgaccacaagcctaccttcacactgccccatcctaccatccatcctcgttggttcgtgttcaacaagcctaagacaaaccccgagggctaccgcaagctgatcctgcctaaaaaggccggcgatctgggcagcctggaaatgagactgctgaccggcgagaagaacaagggcaactaccccgacgactggatcagcgtgaagtttaaggccgatcctcggctgagcctgatcagacccgtgaaaggcagacgggttgtgcggaagggcaaagagcagggccagaccaaagagacagacagctacgagtttttcgacaagcacctgaagaagtggcggcctgccaaactgtctggcgtgaagctgatcttccccgacaagacacctaaggccgcctacctgtacttcacctgtgacatccccgacgagcccctgaccgagacagccaagaaaatccagtggctggaaaccggcgacgtgaccaaaaagggcaagaaacgcaaaaagaaggtgctgccccacggcctggtgtcctgtgctgttgatctgagcatgcggagaggcaccaccggctttgccacactgtgcagatacgagaatggcaagatccacatcctgcggagccggaacctgtgggtcggatacaaagaaggcaagggctgtcacccctacagatggacagagggacccgacctgggacacattgccaagcacaagagagagatcagaatcctgcggtccaagcggggcaagcctgtgaagggcgaagagagccacatcgacctgcagaaacacatcgactacatgggcgaagatcggttcaagaaggccgccagaaccatcgtgaacttcgccctgaacaccgagaacgccgccagcaagaatggcttctaccccagagctgacgtgctgctgctggaaaacctggaaggactgatccccgatgccgagaaagagcggggcatcaatagagccctggccggctggaatagacggcacctggttgagcgcgtgatcgagatggccaaggatgccggcttcaagcggcgggtgttcgagatcccaccttacggcacaagccaagtgtgcagcaaatgtggcgccctgggcagaagatacagcatcatcagagagaacaaccggcgcgagatcagattcggctacgtggaaaagctgttcgcctgtcctaactgcggctactgcgccaacgccgatcacaatgccagcgtgaacctgaaccggcggttcctgatcgaggacagcttcaagtcctactacgactggaagcggctgtccgagaagaagcagaaagaggaaatcgagacaatcgagtccaagctgatggataagctgtgcgccatgcacaagatcagccggggcagcatcagcaagaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 586 - DNA, 8936 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccggatccgccatccggtccatcaagctgaagatgaagaccaacagcggcaccgacagcatctacctgagaaaagccctgtggcggacccaccagctgatcaatgagggaatcgcctactacatgaacctgctgaccctgtaccggcaagaggccatcggcgacaagaccaaagaagcctatcaggccgagctgattaacatcatccggaaccagcagcggaacaacggcagctctgaggaacacggctccgaccaagaaattctggccctgctgagacagctgtacgagctgatcatccccagcagcatcggcgaatctggcgacgctaatcagctgggcaacaagtttctgtaccctctggtggaccccaacagccagtctggcaagggcacatctaacgccggcagaaagcccagatggaagcggctgaaagaggaaggcaaccccgactgggaactcgagaagaagaaggacgaggaacgcaaggccaaggatcccaccgtgaagatctttgacaacctgaacaaatacggcctgctgcctctgttcccactgttcaccaacatccagaaagacatcgagtggctgcccctgggcaagagacagtctgtgcggaagtgggacaaagacatgttcatccaggccatcgagagactgctgagctgggagagctggaacagaagagtggccgacgagtacaaacagctgaaagaaaagaccgagagctactacaaagagcacctgacaggcggcgaggaatggatcgagaagatccggaagttcgagaaagaacggaacatggaactggaaaagaacgccttcgctcccaacgacggctacttcatcaccagcagacagatcagaggctgggacagagtgtacgagaagtggtccaagctgcccgagtctgctagccctgaggaactgtggaaagtggtggccgagcagcagaacaagatgtccgaaggcttcggcgaccccaaggtgttcagcttcctggccaacagagagaaccgggacatttggagaggccacagcgagcggatctaccacattgccgcctacaacggcctgcagaagaagctgagccggaccaaagagcaggccaccttcacactgcctgacgccattgaacaccctctgtggatcagatacgagagccctggcggcaccaacctgaatctgttcaagctggaagagaaacagaaaaagaactactacgtgaccctgagcaagatcatctggcccagcgaggaaaagtggattgagaaagagaacatcgagatccctctggctcccagcatccagttcaaccggcagattaagctgaagcagcacgtgaagggcaagcaagagatcagcttcagcgactacagcagccggatcagcctggatggtgttctcggcggcagcagaatccagtttaatcggaagtacatcaagaaccacaaagagctgctcggagagggcgacatcggccccgtgttctttaacctggtggtggatgtggcccctctgcaagaaaccagaaacggcagactgcagagccccatcggcaaggccctgaaagtgatcagcagcgacttctccaaagtgatcgactacaagccgaaagaactcatggattggatgaataccggcagcgccagcaacagctttggagtggcttctctgctggaaggcatgagagtgatgagcatcgacatgggccagagaaccagcgcctccgtgtccatcttcgaggtcgtgaaagaactgcccaaggatcaagagcagaagctgttctacagcatcaacgacaccgagctgttcgccatccacaagcggagctttctgctgaacctgcctggcgaggtggtcaccaagaacaacaagcagcagcggcaagagcggcggaaaaagcggcagtttgtgcggagccagatcagaatgctggccaacgtgctgcggctggaaacaaagaaaacccctgacgagcggaagaaggccattcacaagctgatggaaatcgtgcagagctacgacagctggaccgccagccagaaagaagtgtgggagaaagagctgaatctcctgaccaacatggccgccttcaatgacgagatctggaaagaaagcctggtggaactgcaccaccggatcgagccttacgtgggacagatcgtgtccaagtggcggaagggcctgtctgagggcagaaagaatctggccggcatcagcatgtggaacatcgacgaactggaagataccaggcggctgctgatttcctggtccaagagaagcagaaccccaggcgaggccaacaggatcgaaaccgatgagcctttcggcagcagcctgctccagcacattcagaacgtgaaggacgacagactgaagcagatggccaacctgatcatcatgacagccctgggctttaagtacgacaaagaggaaaaggaccggtacaagcggtggaaagagacataccccgcctgccagatcatcctgttcgagaacctgaaccgctacctgttcaacctcgaccggtccagacgcgagaacagcagactgatgaagtgggcccatcggagcatccccagaaccgtgtctatgcagggcgagatgttcggcctgcaagtgggcgacgttcggagcgagtacagctccagattccacgccaaaacaggcgcccctggcatcagatgtcacgccctgactgaagaggatctgaaggccggcagcaacaccctgaagagactgatcgaggacggcttcatcaatgagagcgagctggcctacctgaagaagggcgatatcatccctagccaaggcggcgaactgttcgtgacactgtccaagcggtacaagaaggacagcgacaacaacgagctgaccgtgatccacgccgacatcaacgccgctcagaatctgcagaagcggttttggcagcaaaacagcgaggtgtacagagtgccctgtcagctggccagaatgggcgaagataagctgtacatccccaagagccagaccgagacaatcaagaagtatttcggcaagggctccttcgtgaagaacaataccgaacaagaggtctacaagtgggagaagtccgagaaaatgaagatcaagacggacaccaccttcgacctgcaagacctggatggcttcgaggacatcagcaagaccattgagctggcacaagagcagcaaaagaaatacctgaccatgttcagggaccccagcggctactttttcaacaatgagacatggcggcctcaaaaagaatactggtccatcgtgaacaacatcatcaagagctgcctcaagaagaagatcctgagcaacaaggtcgagctgggatccaaaaggccggcggccacgaaaaaggccggccaggcaaaaaagaaaaagggatcttacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 587 - DNA, 6516 bp, Artificial Sequence
  Synthetic Oligonucleotide
accttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacttaattaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggacctatagggtcaatgaatctgtgcgtgtgccataagtaattaaaaattacccaccacaggagcacctgaaaacaggtgcttggcacggagacgatatatcgtctctttttttcaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccggtgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtacccatacgatgttccagattacgcttaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctc

SEQ ID NO: 588 - DNA, 6525 bp, Artificial Sequence
  Synthetic Oligonucleotide
accttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacttaattaagagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggttctgtcttttggtcaggacaaccgtctagctataagtgctgcagggtgtgagaaactcctattgctggacgatgtctcttacgaggcattagcacggagacgatatatcgtctctttttttcaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccggtgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtacccatacgatgttccagattacgcttaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctc

SEQ ID NO: 589 - DNA, 8924 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccggatccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacggagaaaggtcccgcttcgagaacagccggctcatgaagtggtccagacgcgagatccccagacaggttgcactgcagggcgagatctatggcctgcaagtgggagaagtgggcgctcagttcagcagcagattccacgccaagacaggcagccctggcatcagatgtcgggtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgggatccaaaaggccggcggccacgaaaaaggccggccaggcaaaaaagaaaaagggatcttacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 590 - DNA, 8924 bp, Artificial Sequence
  Synthetic Oligonucleotide
agaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatggccccaaagaagaagcggaaggtcggtatccacggagtcccagcagccggatccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacaaggaaaggtcccgcttcgagaacagccggctcatgaagtggtccagacgcgagatccccagacaggttgcactgcagggcgagatctatggcctgcaagtgggagaagtgggcgctcagttcagcagcagattccacgccaagacaggcagccctggcatcagatgtcgggtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgggatccaaaaggccggcggccacgaaaaaggccggccaggcaaaaaagaaaaagggatcttacccatacgatgttccagattacgcttatccctacgacgtgcctgattatgcatacccatatgatgtccccgactatgcctaagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaa

SEQ ID NO: 591 - DNA, 31 bp, Artificial Sequence
  Synthetic Oligonucleotide
gagaagtcatttaataaggccactgttaaaa

SEQ ID NO: 592 - DNA, 23 bp, Artificial Sequence
  Synthetic Oligonucleotide
agacccagaggctcaagtgagca

SEQ ID NO: 593 - DNA, 23 bp, Artificial Sequence
  Synthetic Oligonucleotide
agctgaagggaaataaaaggaaa

SEQ ID NO: 594 - DNA, 23 bp, Artificial Sequence
  Synthetic Oligonucleotide
tctcccctgggaagcatccctgg

SEQ ID NO: 595 - DNA, 23 bp, Artificial Sequence
  Synthetic Oligonucleotide
tcatggagaaaatattcagaatc

SEQ ID NO: 596 - DNA, 23 bp, Artificial Sequence
  Synthetic Oligonucleotide
cctcactcctgctcggtgaattt

SEQ ID NO: 597 - DNA, 23 bp, Artificial Sequence
  Synthetic Oligonucleotide
aggagtgttcagtctccgtgaac

SEQ ID NO: 598 - DNA, 23 bp, Artificial Sequence
  Synthetic Oligonucleotide
ggaggtcagaaatagggggtcca

SEQ ID NO: 599 - DNA, 23 bp, Artificial Sequence
  Synthetic Oligonucleotide
caaagcccattccctctttagcc

SEQ ID NO: 600 - DNA, 23 bp, Artificial Sequence
  Synthetic Oligonucleotide
cccttcagctaaaataaaggagg

SEQ ID NO: 601 - DNA, 23 bp, Artificial Sequence
  Synthetic Oligonucleotide
ttctcccctgggaagcatccctg

SEQ ID NO: 602 - DNA, 23 bp, Artificial Sequence
  Synthetic Oligonucleotide
tgcagagcaaataccagagataa

SEQ ID NO: 603 - DNA, 23 bp, Artificial Sequence
  Synthetic Oligonucleotide
cgccgggccctgaccacgctcat

SEQ ID NO: 604 - DNA, 23 bp, Artificial Sequence
  Synthetic Oligonucleotide
ccgacttcatctttgccaacgtc

SEQ ID NO: 605 - DNA, 23 bp, Artificial Sequence
  Synthetic Oligonucleotide
tagagcactggcatggggatggg

SEQ ID NO: 606 - DNA, 23 bp, Artificial Sequence
  Synthetic Oligonucleotide
ttgctccagaggccccccttggg

SEQ ID NO: 607 - DNA, 23 bp, Artificial Sequence
  Synthetic Oligonucleotide
ctggtgccagaaacaggggtgac

SEQ ID NO: 608 - DNA, 23 bp, Artificial Sequence
  Synthetic Oligonucleotide
tgggcttcaagcaacttgtagtg

SEQ ID NO: 609 - DNA, 23 bp, Artificial Sequence
  Synthetic Oligonucleotide
tgtaattggttctaccaaagaag

SEQ ID NO: 610 - DNA, 23 bp, Artificial Sequence
  Synthetic Oligonucleotide
agaggcggagggcggcgtgcctg

SEQ ID NO: 611 - DNA, 23 bp, Artificial Sequence
  Synthetic Oligonucleotide
cttcagcccaagaacagtacaag

SEQ ID NO: 612 - DNA, 23 bp, Artificial Sequence
  Synthetic Oligonucleotide
tctgtgagtcgaggagaaacgac

SEQ ID NO: 613 - DNA, 23 bp, Artificial Sequence
  Synthetic Oligonucleotide
cttgggtgtgttaaaagtgacca

SEQ ID NO: 614 - DNA, 20 bp, Artificial Sequence
  Synthetic Oligonucleotide
tcactcctgctcggtgaatt

SEQ ID NO: 615 - DNA, 20 bp, Artificial Sequence
  Synthetic Oligonucleotide
gctacaggcagagacaaagg

SEQ ID NO: 616 - DNA, 20 bp, Artificial Sequence
  Synthetic Oligonucleotide
aggtcagaaatagggggtcc

SEQ ID NO: 617 - DNA, 20 bp, Artificial Sequence
  Synthetic Oligonucleotide
caggctgtgaaccttggtgg

SEQ ID NO: 618 - DNA, 20 bp, Artificial Sequence
  Synthetic Oligonucleotide
gaccccctccaccccgcctc

SEQ ID NO: 619 - DNA, 21 bp, Artificial Sequence
  Synthetic Oligonucleotide
gtatctagcctcttctaagac

SEQ ID NO: 620 - DNA, 20 bp, Artificial Sequence
  Synthetic Oligonucleotide
tctcccctgggaagcatccc

SEQ ID NO: 621 - DNA, 20 bp, Artificial Sequence
  Synthetic Oligonucleotide
gagtccgagcagaagaagaa

SEQ ID NO: 622 - DNA, 20 bp, Artificial Sequence
  Synthetic Oligonucleotide
ttttgggagtaagaaaaggt

SEQ ID NO: 623 - DNA, 20 bp, Artificial Sequence
  Synthetic Oligonucleotide
agtgtccagggatgcttccc

SEQ ID NO: 624 - DNA, 23 bp, Artificial Sequence
  Synthetic Oligonucleotide
cctcactcctgctcggtgaattt

SEQ ID NO: 625 - DNA, 23 bp, Artificial Sequence
  Synthetic Oligonucleotide
ggaggtcagaaatagggggtcca

SEQ ID NO: 626 - DNA, 23 bp, Artificial Sequence
  Synthetic Oligonucleotide
gatggcgacttcaggcacaggat

SEQ ID NO: 627 - DNA, 23 bp, Artificial Sequence
  Synthetic Oligonucleotide
ggaagtgtccagggatgcttccc

SEQ ID NO: 628 - DNA, 23 bp, Artificial Sequence
  Synthetic Oligonucleotide
cccttcagctaaaataaaggagg

SEQ ID NO: 629 - DNA, 23 bp, Artificial Sequence
  Synthetic Oligonucleotide
ggctcagcaggcacctgcctcag

SEQ ID NO: 630 - DNA, 23 bp, Artificial Sequence
  Synthetic Oligonucleotide
gggactggagttgcttcatgtac

SEQ ID NO: 631 - DNA, 23 bp, Artificial Sequence
  Synthetic Oligonucleotide
tctccatgaaaaatactggggtc

SEQ ID NO: 632 - DNA, 23 bp, Artificial Sequence
  Synthetic Oligonucleotide
ttcatggagaaaatattcagaat

SEQ ID NO: 633 - DNA, 23 bp, Artificial Sequence
  Synthetic Oligonucleotide
gcagctacaggcagagacaaagg

SEQ ID NO: 634 - DNA, 23 bp, Artificial Sequence
  Synthetic Oligonucleotide
cctggaaaccatccaggccttgt

SEQ ID NO: 635 - DNA, 23 bp, Artificial Sequence
  Synthetic Oligonucleotide
ggtcagctgttaacatcagtacg

SEQ ID NO: 636 - DNA, 23 bp, Artificial Sequence
  Synthetic Oligonucleotide
tcttcacggaaacagggttcctt

SEQ ID NO: 637 - DNA, 23 bp, Artificial Sequence
  Synthetic Oligonucleotide
tggttgcccaccctagtcattgg

SEQ ID NO: 638 - DNA, 23 bp, Artificial Sequence
  Synthetic Oligonucleotide
gatggcgacttcaggcacaggat

SEQ ID NO: 639 - DNA, 23 bp, Artificial Sequence
  Synthetic Oligonucleotide
cctcactcctgctcggtgaattt

SEQ ID NO: 640 - DNA, 23 bp, Artificial Sequence
  Synthetic Oligonucleotide
ggaagtgtccagggatgcttccc

SEQ ID NO: 641 - DNA, 23 bp, Artificial Sequence
  Synthetic Oligonucleotide
ggctcagcaggcacctgcctcag

SEQ ID NO: 642 - DNA, 23 bp, Artificial Sequence
  Synthetic Oligonucleotide
ttcatggagaaaatattcagaat

SEQ ID NO: 643 - DNA, 23 bp, Artificial Sequence
  Synthetic Oligonucleotide
ctgacctcccaaacagctacata

SEQ ID NO: 644 - DNA, 47 bp, Artificial Sequence
  Synthetic Oligonucleotide
  misc_feature (1)..(1): 5' phosphorylated
  misc_feature (1)..(1): 5' phosphorylated
gttgtgagcaagggcgaggaggataacgcctctctcccagcgactat

SEQ ID NO: 645 - DNA, 47 bp, Artificial Sequence
  Synthetic Oligonucleotide
  misc_feature (1)..(1): 5' phosphorylate
atagtcgctgggagagaggcgttatcctcctcgcccttgctcacaac

SEQ ID NO: 646 - DNA, 23 bp, Artificial Sequence
  Synthetic Oligonucleotide
tactttagagcgaaaggcttttc

SEQ ID NO: 647 - DNA, 23 bp, Artificial Sequence
  Synthetic Oligonucleotide
agataccaaagagaacgggatca

SEQ ID NO: 648 - DNA, 23 bp, Artificial Sequence
  Synthetic Oligonucleotide
tgacttcactgtaactgggagag

SEQ ID NO: 649 - DNA, 23 bp, Artificial Sequence
  Synthetic Oligonucleotide
tctcccaggaagggcagcaggct

SEQ ID NO: 650 - DNA, 23 bp, Artificial Sequence
  Synthetic Oligonucleotide
tagacgtggagatcatttttaac

SEQ ID NO: 651 - DNA, 49 bp, Artificial Sequence
  Synthetic Oligonucleotide
aataaaatatctttattttcattacatctgtgtgttggttttttgtgtg

SEQ ID NO: 652 - DNA, 208 bp, Artificial Sequence
  Synthetic Oligonucleotide
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctgggga

SEQ ID NO: 653 - protein, 1190 aa, Artificial Sequence
  Synthetic Peptide
MAPKKKRKVGIHGVPAAAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDIKRPAATKKAGQAKKKKGSYPYDVPDYAYPYDVPDYAYPYDVPDYA

SEQ ID NO: 654 - DNA, 7584 bp, Artificial Sequence
  Synthetic Oligonucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggcctctagactcgaggggctggaagctacctttgacatcatttcctctgcgaatgcatgtataatttctacagaacctattagaaaggatcacccagcctctgcttttgtacaactttcccttaaaaaactgccaattccactgctgtttggcccaatagtgagaactttttcctgctgcctcttggtgcttttgcctatggcccctattctgcctgctgaagacactcttgccagcatggacttaaacccctccagctctgacaatcctctttctcttttgttttacatgaagggtctggcagccaaagcaatcactcaaagttcaaaccttatcattttttgctttgttcctcttggccttggttttgtacatcagctttgaaaataccatcccagggttaatgctggggttaatttataactaagagtgctctagttttgcaatacaggacatgctataaaaatggaaagataccggtgccacaagaggtaagggtttaagggatggttggttggtggggtattaatgtttaattacctggagcacctgcctgaaatcactttttttcaggttggcatggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggacggccaaaaaaagagaccatatatggtctccgtgctaatgcctcgtaagagacatcgtccagcaataggagtttctcacaccctgcagcacttatagctagacggttgtcctgaccaaaagacagaaccggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattccaattatctctctaacagccttgtatcgtatatgcaaatatgaaggaatcatgggaaataggccctcgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 655 - DNA, 7495 bp, Artificial Sequence
  Synthetic Oligonucleotide
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggcctctagactcgaggggctggaagctacctttgacatcatttcctctgcgaatgcatgtataatttctacagaacctattagaaaggatcacccagcctctgcttttgtacaactttcccttaaaaaactgccaattccactgctgtttggcccaatagtgagaactttttcctgctgcctcttggtgcttttgcctatggcccctattctgcctgctgaagacactcttgccagcatggacttaaacccctccagctctgacaatcctctttctcttttgttttacatgaagggtctggcagccaaagcaatcactcaaagttcaaaccttatcattttttgctttgttcctcttggccttggttttgtacatcagctttgaaaataccatcccagggttaatgctggggttaatttataactaagagtgctctagttttgcaatacaggacatgctataaaaatggaaagataccggtgccaccatggccccaaagaagaagcggaaggtcggtatccacggagtcccagcagccgccatccggtccatcaagctgaagatgaagaccaacagcggcaccgacagcatctacctgagaaaagccctgtggcggacccaccagctgatcaatgagggaatcgcctactacatgaacctgctgaccctgtaccggcaagaggccatcggcgacaagaccaaagaagcctatcaggccgagctgattaacatcatccggaaccagcagcggaacaacggcagctctgaggaacacggctccgaccaagaaattctggccctgctgagacagctgtacgagctgatcatccccagcagcatcggcgaatctggcgacgctaatcagctgggcaacaagtttctgtaccctctggtggaccccaacagccagtctggcaagggcacatctaacgccggcagaaagcccagatggaagcggctgaaagaggaaggcaaccccgactgggaactcgagaagaagaaggacgaggaacgcaaggccaaggatcccaccgtgaagatctttgacaacctgaacaaatacggcctgctgcctctgttcccactgttcaccaacatccagaaagacatcgagtggctgcccctgggcaagagacagtctgtgcggaagtgggacaaagacatgttcatccaggccatcgagagactgctgagctgggagagctggaacagaagagtggccgacgagtacaaacagctgaaagaaaagaccgagagctactacaaagagcacctgacaggcggcgaggaatggatcgagaagatccggaagttcgagaaagaacggaacatggaactggaaaagaacgccttcgctcccaacgacggctacttcatcaccagcagacagatcagaggctgggacagagtgtacgagaagtggtccaagctgcccgagtctgctagccctgaggaactgtggaaagtggtggccgagcagcagaacaagatgtccgaaggcttcggcgaccccaaggtgttcagcttcctggccaacagagagaaccgggacatttggagaggccacagcgagcggatctaccacattgccgcctacaacggcctgcagaagaagctgagccggaccaaagagcaggccaccttcacactgcctgacgccattgaacaccctctgtggatcagatacgagagccctggcggcaccaacctgaatctgttcaagctggaagagaaacagaaaaagaactactacgtgaccctgagcaagatcatctggcccagcgaggaaaagtggattgagaaagagaacatcgagatccctctggctcccagcatccagttcaaccggcagattaagctgaagcagcacgtgaagggcaagcaagagatcagcttcagcgactacagcagccggatcagcctggatggtgttctcggcggcagcagaatccagtttaatcggaagtacatcaagaaccacaaagagctgctcggagagggcgacatcggccccgtgttctttaacctggtggtggatgtggcccctctgcaagaaaccagaaacggcagactgcagagccccatcggcaaggccctgaaagtgatcagcagcgacttctccaaagtgatcgactacaagccgaaagaactcatggattggatgaataccggcagcgccagcaacagctttggagtggcttctctgctggaaggcatgagagtgatgagcatcgacatgggccagagaaccagcgcctccgtgtccatcttcgaggtcgtgaaagaactgcccaaggatcaagagcagaagctgttctacagcatcaacgacaccgagctgttcgccatccacaagcggagctttctgctgaacctgcctggcgaggtggtcaccaagaacaacaagcagcagcggcaagagcggcggaaaaagcggcagtttgtgcggagccagatcagaatgctggccaacgtgctgcggctggaaacaaagaaaacccctgacgagcggaagaaggccattcacaagctgatggaaatcgtgcagagctacgacagctggaccgccagccagaaagaagtgtgggagaaagagctgaatctcctgaccaacatggccgccttcaatgacgagatctggaaagaaagcctggtggaactgcaccaccggatcgagccttacgtgggacagatcgtgtccaagtggcggaagggcctgtctgagggcagaaagaatctggccggcatcagcatgtggaacatcgacgaactggaagataccaggcggctgctgatttcctggtccaagagaagcagaaccccaggcgaggccaacaggatcgaaaccgatgagcctttcggcagcagcctgctccagcacattcagaacgtgaaggacgacagactgaagcagatggccaacctgatcatcatgacagccctgggctttaagtacgacaaagaggaaaaggaccggtacaagcggtggaaagagacataccccgcctgccagatcatcctgttcgagaacctgaaccgctacctgttcaacctcgaccggtccagacgcgagaacagcagactgatgaagtgggcccatcggagcatccccagaaccgtgtctatgcagggcgagatgttcggcctgcaagtgggcgacgttcggagcgagtacagctccagattccacgccaaaacaggcgcccctggcatcagatgtcacgccctgactgaagaggatctgaaggccggcagcaacaccctgaagagactgatcgaggacggcttcatcaatgagagcgagctggcctacctgaagaagggcgatatcatccctagccaaggcggcgaactgttcgtgacactgtccaagcggtacaagaaggacagcgacaacaacgagctgaccgtgatccacgccgacatcaacgccgctcagaatctgcagaagcggttttggcagcaaaacagcgaggtgtacagagtgccctgtcagctggccagaatgggcgaagataagctgtacatccccaagagccagaccgagacaatcaagaagtatttcggcaagggctccttcgtgaagaacaataccgaacaagaggtctacaagtgggagaagtccgagaaaatgaagatcaagacggacaccaccttcgacctgcaagacctggatggcttcgaggacatcagcaagaccattgagctggcacaagagcagcaaaagaaatacctgaccatgttcagggaccccagcggctactttttcaacaatgagacatggcggcctcaaaaagaatactggtccatcgtgaacaacatcatcaagagctgcctcaagaagaagatcctgagcaacaaggtcgagctgaaaaggccggcggccacgaaaaaggccggccaggcaaaaaagaaaaagggatcctacccatacgatgttccagattacgcttatccctacgacgtgcctgattatgcatacccatatgatgtccccgactatgcctaagaattcctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagagaatagcaggcatgctggggacggccaaaaaaagagaccatatatggtctccgtgccaagcacctgttttcaggtgctcctgtggtgggtaatttttaattacttatggcacacgcacagattcattgaccctataggtccggtgtttcgtcctttccacaagatatataaagccaagaaatcgaaatactttcaagttacggtaagcatatgatagtccattttaaaacataattttaaaactgcaaactacccaagaaattattactttctacgtcacgtattttgtactaatatctttgtgtttacagtcaaattaattccaattatctctctaacagccttgtatcgtatatgcaaatatgaaggaatcatgggaaataggccctcgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggaagccgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 656 - RNA, 14 nt, Artificial Sequence
  Synthetic Oligonucleotide
ccgcgaauggacac

SEQ ID NO: 657 - DNA, 25 bp, Artificial Sequence
  Synthetic Oligonucleotide
tagatgaattaaatgtgattagcac

SEQ ID NO: 658 - DNA, 25 bp, Artificial Sequence
  Synthetic Oligonucleotide
agcgagcggtctgagaagtggcact

SEQ ID NO: 659 - DNA, 23 bp, Artificial Sequence
  Synthetic Oligonucleotide
gcagaaataatgatgattggcac

SEQ ID NO: 660 - RNA, 36 nt, Artificial Sequence; identical to SEQ ID NO: 549
  Synthetic Oligonucleotide

SEQ ID NO: 661 - RNA, 21 nt, Artificial Sequence
  Synthetic Oligonucleotide
gggcgaucugagaaguggcac

SEQ ID NO: 662 - RNA, 20 nt, Artificial Sequence
  Synthetic Oligonucleotide
augauacgaggcauuagcac

SEQ ID NO: 663 - protein, 102 aa, Artificial Sequence
  Synthetic Peptide
SGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 664 - protein, 21 aa, Artificial Sequence
  Synthetic
GGSGGSGGSGGSGGSGGSGGS

SEQ ID NO: 665 - DNA, 47 bp, Artificial Sequence
  Synthetic oligonucleotide
agagaccctgggacggtctcagttgggactgctctcactttgaaggg

What is claimed is:

1. A non-naturally occurring or engineered system comprising:

i) a Cas12b effector protein, or a polynucleotide encoding the Cas12b effector protein, wherein the Cas12b effector is at least 95% identical to SEQ ID NO: 519; and ii) one or more guide molecules each comprising a guide sequence capable of hybridizing to a target sequence, and a tracrRNA, or a polynucleotide encoding the one or more guide molecules, and wherein the Cas12b effector protein comprises one or more mutations at amino acid positions selected from K846, S893, E837, or any combination thereof relative to SEQ ID NO: 519.

2. The system of claim 1, wherein the tracrRNA is fused to the guide sequence at a 5' end of a direct repeat sequence.

3. The system of claim 1, wherein the Cas12b effector protein comprises one or more mutations selected from K846R, S893R, E837G, or any combination thereof relative to SEQ ID NO: 519.

7. The system of claim 1, wherein the Cas12b effector protein comprises one or more nuclear localization signals (NLSs) and/or is associated with at least two heterologous functional domains, wherein a first heterologous functional domain cleaves a target sequence, and wherein a second heterologous functional domain modifies the target sequence, transcription or translation of the target sequence, or any combination thereof.

8. The system of claim 1, wherein the Cas12b effector protein is a Cas12b effector nickase, or wherein the Cas12b effector protein is catalytically inactive.

9. The system of claim 1, further comprising a recombination template, wherein the recombination template is capable of being inserted into a target sequence by homology-directed repair (HDR).

10. A Cas12b vector system, which comprises one or more vectors comprising:

a first regulatory element operably linked to the polynucleotide encoding the Cas12b effector protein of claim 1; and a second regulatory element operably linked to the polynucleotide encoding the one or more guide molecules of claim 1, wherein the polynucleotide sequence encoding the Cas12b effector protein is codon optimized for expression in a eukaryotic cell.

11. The vector system of claim 10, wherein the first regulatory element operably linked to the polynucleotide sequence encoding the Cas12b effector protein and the second regulatory element operably linked to the polynucleotide sequence encoding the one or more guide molecules are on a single vector.

12. The vector system of claim 10, wherein the one or more vectors comprise viral vectors, or wherein the one or more vectors comprise one or more retroviral, lentiviral, adenoviral, adeno-associated or herpes simplex viral vectors.

13. A delivery system configured to deliver the non-naturally occurring or engineered system of claim 1, comprising:

(a) one or more polynucleotides encoding component (i) of claim 1, and one or more polynucleotides encoding component (ii) of claim 1;

(b) one or more vectors comprising (a); or (c) a delivery vehicle comprising (a), (b), or both (a) and (b), wherein the delivery vehicle further comprises a liposome, a particle, an exosome, a microvesicle, a gene gun, a viral vector, or any combination thereof.

14. A method of modifying one or more target sequences of interest, the method comprising contacting the one or more target sequences of interest with one or more non-naturally occurring or engineered systems of claim 1, whereby there is formed a CRISPR complex comprising the Cas12b effector protein complexed with the one or more guide molecules, and wherein the one or more guide molecules direct sequence-specific binding to the one or more target sequences of interest in a cell, wherein modifying the one or more target sequences of interest comprises an insertion or deletion of one or more nucleotides.

15. The method of claim 14, wherein the one or more target sequences of interest is in a prokaryotic cell, or in a eukaryotic cell.

16. A method of modifying one or more target sequences of interest, the method comprising contacting the one or more target sequences of interest with one or more non-naturally occurring or engineered systems of claim 1, wherein the one or more non-naturally occurring or engineered systems further comprise an engineered adenosine deaminase coupled to the Cas12b effector protein, wherein the Cas12b effector protein is catalytically inactive, whereby there is formed a CRISPR complex comprising the Cas12b effector protein complexed with the one or more guide molecules, wherein the one or more guide molecules direct sequence-specific binding to the one or more target sequences of interest in a cell, and whereby modifying the one or more target sequences comprises deaminating one or more nucleotides in the one or more target sequences of interest.

17. A method of modifying one or more target sequences of interest, the method comprising contacting the one or more target sequences of interest with one or more non-naturally occurring or engineered systems of claim 1, wherein the one or more non-naturally occurring or engineered systems further comprise an engineered transcriptional activator or repressor coupled to the Cas12b effector protein, wherein the Cas12b effector protein is catalytically inactive, whereby there is formed a CRISPR complex comprising the Cas12b effector protein complexed with the one or more guide molecules, wherein the one or more guide molecules direct sequence-specific binding to the one or more target sequences of interest in a cell, and whereby modifying the one or more target sequences of interest comprises increasing or decreasing expression of the one or more target sequences of interest.

18. An isolated Cas12b effector protein at least 95% identical to SEQ ID NO: 519, wherein the Cas12b effector protein comprises one or more mutations at amino acid positions selected from K846, S893, E837, or any combination thereof relative to SEQ ID NO: 519, or an isolated nucleic acid encoding said Cas12b effector protein, optionally wherein the isolated nucleic acid is a DNA and further comprises a sequence encoding a crRNA and a tracr RNA.

19. A system for detecting the presence of one or more target sequences in one or more in vitro samples, comprising:

the isolated Cas12b effector protein or the isolated nucleic acid encoding said Cas12b effector protein of claim 18;

one or more guide molecules capable of hybridizing with the one or more target sequences and designed to form a complex with the Cas12b effector protein; and an oligonucleotide-based masking construct comprising a non-target sequence, wherein the Cas12b effector protein exhibits collateral nuclease activity and cleaves the non-target sequence of the oligonucleotide-based masking construct once activated by the one or more target sequences; and nucleic acid amplification reagents to amplify the target sequence, wherein the nucleic acid amplification reagents are isothermal amplification reagents.

20. A method for detecting one or more target sequences in one or more in vitro samples, comprising:

contacting one or more samples with:

the isolated Cas12b effector protein or the isolated nucleic acid encoding said Cas12b effector protein of claim 18; and an oligonucleotide-based masking construct comprising a non-target sequence, wherein said Cas12b effector protein exhibits collateral nuclease activity and cleaves the non-target sequence of the oligonucleotide-based masking construct.

21. An isolated eukaryotic cell comprising:

i) a Cas12b effector protein, or a polynucleotide encoding the Cas12b effector protein, wherein the Cas12b effector protein is at least 95% identical to SEQ ID NO: 519; and ii) one or more guide molecules each comprising a guide sequence capable of hybridizing to a target sequence, and a tracrRNA, or one or more polynucleotides encoding the one or more guide molecules, and wherein the Cas12b effector protein comprises one or more mutations at amino acid positions selected from K846, S893, E837, or any combination thereof relative to SEQ ID NO: 519.

22. An engineered composition for site directed base editing comprising:

(a) a targeting domain; (b) an adenosine deaminase, cytidine deaminase, or catalytic domain thereof; and (c) a guide molecule, wherein the targeting domain comprises a Cas12b effector protein or a polynucleotide encoding the Cas12b effector protein wherein the Cas12b effector protein is at least 95% identical to SEQ ID NO: 519, wherein the Cas12b effector protein comprises one or more mutations at amino acid positions selected from K846, S893, E837, or any combination thereof relative to SEQ ID NO: 519, and wherein said adenosine or cytidine deaminase protein or catalytic domain thereof is covalently or non-covalently linked to said Cas12b effector protein.

23. The engineered composition of claim 22, wherein the Cas12b effector protein is catalytically inactive.

24. A method of modifying an adenine or cytosine in a target oligonucleotide, comprising delivering to said target oligonucleotide the engineered composition of claim 23, wherein said guide molecule forms a complex with said Cas12b effector protein and directs said complex to bind said target oligonucleotide, wherein said guide molecule is capable of hybridizing with a target sequence within said target oligonucleotide to form an oligonucleotide duplex, optionally wherein: (A) said adenine or cytosine is outside said target sequence that forms said oligonucleotide duplex, wherein said adenosine deaminase, cytidine deaminase, or catalytic domain thereof deaminates said adenine or cytosine outside said oligonucleotide duplex, or (B) said adenine or cytosine is within said target sequence that forms said oligonucleotide duplex, wherein said guide sequence comprises a non-pairing adenine, non-pairing uracil, or non-pairing cytosine at a position corresponding to said adenine or cytosine resulting in a C-A or C-U mismatch in said oligonucleotide duplex, and wherein the adenosine deaminase, cytidine deaminase, or catalytic domain thereof deaminates the adenine or cytosine in the oligonucleotide duplex opposite to the non-pairing adenine, non-pairing uracil, or non-pairing cytosine.

25. A method of modifying an adenosine or cytidine in one or more target oligonucleotides of interest, comprising delivering to said one or more target oligonucleotides, the engineered composition according to claim 22, optionally for use in treating or preventing a disease caused by transcripts containing a pathogenic T→C or A→G point mutation.

26. A system for detecting the presence of target polypeptides in one or more in vitro samples comprising:

a Cas12b effector protein that is at least 95% identical to SEQ ID NO: 519, or a polynucleotide encoding the Cas12b effector protein, and wherein the Cas12b effector protein comprises one or more mutations at amino acid positions selected from K846, S893, E837, or any combination thereof relative to SEQ ID NO: 519;

one or more detection aptamers, each designed to bind to one of the target polypeptides, each detection aptamer comprising a masked promoter binding site or masked primer binding site and a target sequence template;

an oligonucleotide-based masking construct comprising a non-target sequence, further comprising nucleic acid amplification reagents to amplify a target sequence, and wherein the nucleic acid amplification reagents are isothermal amplification reagents.

* * * * *